United States Patent 11,241,485 (PDE5 COMPOSITIONS AND METHODS FOR IMMUNOTHERAPY) - sequence listing, part 2

SEQ ID NO: 4964 - protein, 215 aa, Artificial Sequence
  Description of Artificial Sequence: Synthetic light chain variable domain
DIQMTQSPILLSASVGDRVTITCQASQRISSYLSWYQQRTNGSPRLLIYGASTLASGVPSRFSGSRSGTDFTLTISSLQPEDEADYYCQSYFDSNWHAFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4965 - protein, 110 aa, Artificial Sequence
  Description of Artificial Sequence: Synthetic light chain variable domain
DVVMTQTPASVSEPVGGTVTIKCQASQRISSYLSWYQQKPGQRPKLLIFGASTLASGVPSRFKGSGSGTEYTLTISDLECADAATYYCQSYAYFDSNNWHAFGGGTEVVV

SEQ ID NO: 4966 - protein, 109 aa, Artificial Sequence
  Description of Artificial Sequence: Synthetic light chain variable domain
DVVMTQTPSPVSAAVGGTVTIKCQASQSINNGLAWYQQKPGQPPRLLIYSASNLESGVPSRFKGSGSGTEFTLTISDLECDDAATYYCQCIWDGNSYVNAFGGGTEVVV

SEQ ID NO: 4967 - protein, 106 aa, Artificial Sequence
  Description of Artificial Sequence: Synthetic light chain variable domain
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIK

SEQ ID NO: 4968 - protein, 109 aa, Artificial Sequence
  Description of Artificial Sequence: Synthetic light chain variable domain
AYDMTQTPASVSAAVGGTVTIKCQASQSISTALAWYQQKPGQPPKVLIYAASNLASGVSSRFKGSGSGTEFTLTISDLECADAATYYCQQAATIINVDNVFGGGTEVVV

SEQ ID NO: 4969 - protein, 111 aa, Artificial Sequence
  Description of Artificial Sequence: Synthetic light chain variable domain
DIVMTQTPASVEVAVGGTVTIKCQASENMYNSLAWYQQKPGQPPKLLIYRASTLESGVPSRFKGSGSGTEYTLTISDLECADAATYYCQCTFYSHNNNYGGAFGGGTEVVV

SEQ ID NO: 4970 - protein, 108 aa, Artificial Sequence
  Description of Artificial Sequence: Synthetic light chain variable domain
DIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 4971 - protein, 214 aa, Artificial Sequence
  Description of Artificial Sequence: Synthetic light chain variable domain
DIELTQSPIIMSASPGEKVTMTCSASSSVSYMEIWYQQRTNGSPRRWIYDTSKLASGVPGRFSGSGSGNSYSLTISSVEAEDIADYYCQQWSKHPLTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4972 - protein, 214 aa, Artificial Sequence
  Description of Artificial Sequence: Synthetic light chain variable domain
DIELTQSPIIMSASPGEKVTMTCSASSSVSYMEIWYQQRTNGSPRRWIYDTSKLASGVPGRFSGSGSGNSYSLTISSVEAEDEADYYCQQWSKHPLTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4973 - protein, 108 aa, Artificial Sequence
  Description of Artificial Sequence: Synthetic light chain variable domain
DIQMTQSPSSLSASVGDRVTITCRASQNILSYLNWYQQKPGKAPKLLIYAASSLQSGVPSRFSGSGSGTDFTLTISSLQPEDFAVYYCQQYGSVPTFGQGTKVEIKRT

SEQ ID NO: 4974 - protein, 106 aa, Artificial Sequence
  Description of Artificial Sequence: Synthetic light chain variable domain
DIELTQPPSVSVAPGQTARISCSGDNLGSYYVHWYQQKPGQAPVLVIYDDNNRPSGIPERFSGSNSGNTATLTISGTQAEDEADYYCQSYDFGKVVFGGGTKLTVL

SEQ ID NO: 4975 - protein, 105 aa, Artificial Sequence
  Description of Artificial Sequence: Synthetic light chain variable domain
DIELTQPPSVSVAPGQTARISCSGDNLPDFYVHWYQQKPGQAPVLVISEDNKRPSGIPERFSGSNSGNTATLTISGTQAEDEADYYCSTYGYTYSYSVFGGGTKL

SEQ ID NO: 4976 - protein, 109 aa, Artificial Sequence
  Description of Artificial Sequence: Synthetic light chain variable domain
DIQMTQSPSSLSASVGDRVTITCRASQNISNYLNWYQQKPGKAPKLLIHKVSNLQSGVPSRFSGSGSGTDFTLTISSLQPEDFAVYYCLQYDDFPRTFGQGTKVEIKRT

SEQ ID NO: 4977 - protein, 107 aa, Artificial Sequence
  Description of Artificial Sequence: Synthetic light chain variable domain
DIQMTQSPSSLSASVGDRVTITCRASQDISNRLAWYQQKPGKAPKLLIYDANSLQSGVPSRFSGSGSGTDFTLTISSLQPEDFATYYCFQYSGPTFGQGTKVEIKRT

SEQ ID NO: 4978 - protein, 114 aa, Artificial Sequence
  Description of Artificial Sequence: Synthetic light chain variable domain
DIVMTQSPLSLPVTPGEPASISCRSSQSLVYSNGNTTLSWYLQKPGQSPQLLIYGVSNRASGVPDRFSGSGSGTDFTLKISRVEAEDVGVYYCQQYNSFPRTFGQGTKVEIKRT

SEQ ID NO: 4979 - protein, 109 aa, Artificial Sequence
  Description of Artificial Sequence: Synthetic light chain variable domain
DIQMTQSPSSLSASVGDRVTITCRASQDINNYLSWYQQKPGKAPKLLIYGASNLQSGVPSRFSGSGSGTDFTLTISSLQPEDFAVYYCQQYYGRPTTFGQGTKVEIKRT

SEQ ID NO: 4980 - protein, 114 aa, Artificial Sequence
  Description of Artificial Sequence: Synthetic light chain variable domain
DIVMTQSPLSLPVTPGEPASISCRSSQSLVHSNGYNYLSWYLQKPGQSPQLLIYLGSNRASGVPDRFSGSGSGTDFTLKISRVEAEDVGVYYCHQYGDFSDTFGQGTKVEIKRT

SEQ ID NO: 4981 - protein, 107 aa, Artificial Sequence
  Description of Artificial Sequence: Synthetic light chain variable domain
DIVLTQPPSVSGAPGQRVTISCSGSSSNIGSYYVNWYQQLPGTAPKLLIYADDKRPSGVPDRFSGSKSGTSASLAITGLQSEDEADYYCQSYDSTKDDSVFGGGTKL

SEQ ID NO: 4982 - protein, 103 aa, Artificial Sequence
  Description of Artificial Sequence: Synthetic light chain variable domain
DIELTQPPSVSVAPGQTARISCSGDNLGSYYVHWYQQKPGQAPVLVIYDDNNRPSGIPERFSGSNSGNTATLTISGTQAEDEADYYCQSYDFGKVVFGGGTKL

SEQ ID NO: 4983 - protein, 109 aa, Artificial Sequence
  Description of Artificial Sequence: Synthetic light chain variable domain
SYELTQETGVSVALGRTVTITCRGDSLRSHYASWYQKKPGQAPILLFYGKNNRPSGVPDRFSGSASGNRASLTISGAQAEDDAEYYCSSRDKSGSRLSVFGGGTKLTVL

SEQ ID NO: 4984 - protein, 113 aa, Artificial Sequence
  Description of Artificial Sequence: Synthetic light chain variable domain
DVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKR

SEQ ID NO: 4985 - protein, 113 aa, Artificial Sequence
  Description of Artificial Sequence: Synthetic light chain variable domain
DIVMSQSPSSLAVSVGEKVTLSCKSSQSLLYSSDQKNYLAWYQQKPGQSPKLLIYWASTRESGVPDRFTGSGSGTDFTLTISSVKAEDLAVYYCQQYYRYPFTFGSGTQLEIK

SEQ ID NO: 4986 - protein, 89 aa, Artificial Sequence
  Description of Artificial Sequence: Synthetic light chain variable domain
VSFSCRASQSIGTSIHWYQQRTNGSPRLLIKFASESISGIPSRFSGSGSGTDFTLSINSVESEDIADYYCQQSNSWPITFGAGTRLELK

SEQ ID NO: 4987 - protein, 116 aa, Artificial Sequence
  Description of Artificial Sequence: Synthetic light chain variable domain
QVQLKESGPGLVAPSQSLSMTCTVSGFSLTTYGVHWVRQPPGKGLEWLVVIWSDGSTTYNSPLKSRLSISRDNSKSQVFLKMNSLQADDTAIYYCAKNYLGSLDYWGQGTSVTVSS

SEQ ID NO: 4988 - protein, 112 aa, Artificial Sequence
  Description of Artificial Sequence: Synthetic light chain variable domain
DVVLTQTPLSLPVSLGDQASISCRSSQSLVHNNGDTYLHWYLQKPGQSPKLLIYKVSNRFSGVPDRFSGSGSGTDFTFKISRVEAEDLGVYFCSQTTHVPLTFGAGTKLELK

SEQ ID NO: 4989 - protein, 120 aa, Artificial Sequence
  Description of Artificial Sequence: Synthetic light chain variable domain
DVVMTQTPLSLPVSLGDQASISCRSSQSLVHSNGNTYLHWYLQKPGQSPKLLIYKVSNRFSGVPDRFSGSGSGTDFTLKINRVEAEDLGVYFCSQGTHVPPTFGGGTKLEIKRADAAPTV

SEQ ID NO: 4990 - protein, 107 aa, Artificial Sequence
  Description of Artificial Sequence: Synthetic light chain variable domain
NIVMTQSPKSMSMSVGERVTLTCKASENVGTYVSWYQQKPEQSPKLLIYGASNRYTGVPNRFTGSGSATDFTLTISSVQAEDLADYYCGQSYSYPWTFGGGTKLEIK

SEQ ID NO: 4991 - protein, 107 aa, Artificial Sequence
  Description of Artificial Sequence: Synthetic light chain variable domain
SIVMTQTPKFLPVSAGDRVTVTCKASQSVGNYVAWYQQKPGQSPKLLIYFASNRYSGVPDRFTGSGSGTDFTFTISSVQVEDLAVYFCQQHYIFPYTFGSGTKLEIK

SEQ ID NO: 4992 - protein, 111 aa, Artificial Sequence
  Description of Artificial Sequence: Synthetic light chain variable domain
DIVLTQSPGSLAVSLGQSVTISCRASESVQYSGTSLMHWYQQKPGQPPKLLIYGASNVETGVPARFSGSGSGTDFSLNIHPVEEDDIAMYFCQQNWKVPWTFGGGTKLEIK

SEQ ID NO: 4993 - protein, 109 aa, Artificial Sequence
  Description of Artificial Sequence: Synthetic light chain variable domain
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKN

SEQ ID NO: 4994 - protein, 112 aa, Artificial Sequence
  Description of Artificial Sequence: Synthetic light chain variable domain
DIVMTQAAPSVSVTPGESVSISCRSSKSLRKSNGNTYLYWFLQRPGQSPQRLIYYMSNLASGVPDRFSGRGSGTDFTLRISRVEAEDVGVYYCMQSLEYPLTFGGGTKLKIK

SEQ ID NO: 4995 - protein, 112 aa, Artificial Sequence
  Description of Artificial Sequence: Synthetic light chain variable domain
DIVMTQAAPSIPVTPGESVSISCRSSKSLLHSNGNTYLYWFLQRPGQSPQRLIYYMSNLASGVPDRFSGRGSGTDFTLKISRVEAGDVGVYYCMQGLEHPLTFGGGTKLEIK

SEQ ID NO: 4996 - protein, 109 aa, Artificial Sequence
  Description of Artificial Sequence: Synthetic light chain variable domain
ELDMTQTPPSLSASVGETVRIRCLASEDIYSGISWYQQKPGKPPTLLIYGASNLESGVPPRFSGSGSGTDYTLTIGGVQAEDAATYYCLGGYSYSSTLTFGAGTNVEIK

SEQ ID NO: 4997 - protein, 112 aa, Artificial Sequence
  Description of Artificial Sequence: Synthetic light chain variable domain
DIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQSLEYPLTFGGGTKLEIK

SEQ ID NO: 4998 - protein, 116 aa, Artificial Sequence; identical to SEQ ID NO: 4987
  Description of Artificial Sequence: Synthetic light chain variable domain

SEQ ID NO: 4999 - protein, 112 aa, Artificial Sequence; identical to SEQ ID NO: 4988
  Description of Artificial Sequence: Synthetic light chain variable domain

SEQ ID NO: 5000 - protein, 120 aa, Artificial Sequence; identical to SEQ ID NO: 4989
  Description of Artificial Sequence: Synthetic light chain variable domain

SEQ ID NO: 5001 - protein, 105 aa, Artificial Sequence
  Description of Artificial Sequence: Synthetic light chain variable domain
NIVMTQPKSMSMSVGERVTLTCKASENVGTYVSWYWKPEQSPKLLIYGASNRYTGVPNRFTGSGSATDFTLTISSVQAEDLADYYCGQSYSYPWTFGGGTKLEIK

SEQ ID NO: 5002 - protein, 107 aa, Artificial Sequence; identical to SEQ ID NO: 4991
  Description of Artificial Sequence: Synthetic light chain variable domain

SEQ ID NO: 5003 - protein, 111 aa, Artificial Sequence
  Description of Artificial Sequence: Synthetic light chain variable domain
DIVLTQSPGSLAVSLGQSVTISCRASESVQYSGTSLMHWYQQKPGQPPKLLIYGASNVETGVPARFSGSGSGTDFSLNIHPVEEDDIAMYFCGQNWKVPWTFGGGTKLEIK

SEQ ID NO: 5004 - protein, 107 aa, Artificial Sequence
  Description of Artificial Sequence: Synthetic light chain variable domain
DILLTQSPAILSVSPGERVSFSCRASQSIGTSIHWYQQRTNGSPRLLIKYASESISGIPSRFSGSGSGTDFTLSINSVESEDIADYYCQQSNNWPLTFGAGTKLELK

SEQ ID NO: 5005 - protein, 113 aa, Artificial Sequence
  Description of Artificial Sequence: Synthetic light chain variable domain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYNTPFTFGPGTKVEIK

SEQ ID NO: 5006 - protein, 113 aa, Artificial Sequence
  Description of Artificial Sequence: Synthetic light chain variable domain
DIVMTQSPDSLAVSLGERATINCRSSQNLLYNSNKLNYLSWYQQKPGQPPKLLIYWASTRESGVPDRFSGSGSGTDFTLTISSLQAEDVAVYYCQQYYNTPFTFGPGTKVEIK

SEQ ID NO: 5007 - protein, 112 aa, Artificial Sequence
  Description of Artificial Sequence: Synthetic light chain variable domain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGQGTKLEI

SEQ ID NO: 5008 - protein, 113 aa, Artificial Sequence
  Description of Artificial Sequence: Synthetic light chain variable domain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGQGTKLEIN

SEQ ID NO: 5009 - protein, 112 aa, Artificial Sequence
  Description of Artificial Sequence: Synthetic light chain variable domain
DIVMTQSPDSLAVSLGERATINCKSSQSVLYSSNNKNYLAWYQQKPGQPPKLLIYWASTRESGVPDRFSGSGSGTDFTLTISSLQAEDVAIYYCQQYYSTPFTFGQGTKLEI

SEQ ID NO: 5010 - protein, 112 aa, Artificial Sequence
  Description of Artificial Sequence: Synthetic light chain variable domain
QSVLTQPPSVSGAPGQRVTISCTGSSYNIGAGYDVHWYQQVPGTAPKLLIYGNSNRPSGVPDRFSGSKSGTSASLAITGLQAEDEADYYCQSYDSSLSGSGVFGGGTKLTVL

SEQ ID NO: 5011 - protein, 112 aa, Artificial Sequence
  Description of Artificial Sequence: Synthetic light chain variable domain
QSVLTQPPSVSGAPGQRVTISCTGSSSNIGAGYDVHWYQQLPGTAPKLLIYGNSYRPSGVPDRFSGSKSGTSASLAITGLQAEDEADYYCQSYDSSLSGSGVFGGGTKLTVL

SEQ ID NO: 5012 - protein, 112 aa, Artificial Sequence
  Description of Artificial Sequence: Synthetic light chain variable domain
QSVLTQPPSVSGAPGQGVTISCTGSSSNIGAGYDVHWYQQLPGSAPKFFIYGSNNRPSGVPDRFSGSKSGTSASLAITGLQAEDEADYYCQSYDSSLSGSGVFGGGTKLTVL

SEQ ID NO: 5013 - protein, 112 aa, Artificial Sequence
  Description of Artificial Sequence: Synthetic light chain variable domain
DIVMTQSPLSLPVTPGEPASISCRSSQSLLHSNGYNYLDWYLQKPGQSPQLLIYFASNRASGVPDRFSGSGSGTDFTLKISRVEAEDVGVYYCMQALQTPEAFGGGTKVEIK

SEQ ID NO: 5014 - protein, 112 aa, Artificial Sequence
  Description of Artificial Sequence: Synthetic light chain variable domain
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPEAFGGGTKVEIK

SEQ ID NO: 5015 - protein, 112 aa, Artificial Sequence
  Description of Artificial Sequence: Synthetic light chain variable domain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPEAFGGGTKVEIK

SEQ ID NO: 5016 - protein, 112 aa, Artificial Sequence
  Description of Artificial Sequence: Synthetic light chain variable domain
DIVMTQSPLSLPVTPGEPASISCRSSQSLLHSNGYNYLDWYLQKPGQSPQLLIYLGSNRASGVPDRFSGSGSGAHFTLKISRVEAEDVGVYYCMQALQTPEAFGGGTKVEIK

SEQ ID NO: 5017 - protein, 112 aa, Artificial Sequence
  Description of Artificial Sequence: Synthetic light chain variable domain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPETFGQGTKVEIK

SEQ ID NO: 5018 - protein, 112 aa, Artificial Sequence
  Description of Artificial Sequence: Synthetic light chain variable domain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPQTFGQGTKVEIK

SEQ ID NO: 5019 - protein, 112 aa, Artificial Sequence
  Description of Artificial Sequence: Synthetic light chain variable domain
DIVMTQSPLSLPVTPGEPASISCRSSQSLLHINGYKYLDWYLQKPGQSPQLLIYLGSNRASGVPDRFSASGSGTDFTLQISRVEAEDVGVYYCMQALQTPQTFGQGTKVEIK

SEQ ID NO: 5020 - protein, 112 aa, Artificial Sequence
  Description of Artificial Sequence: Synthetic light chain variable domain
DIVMTQSPLSLPVTPGESASISCRSSQRLLSSSGNNYLDWYLQKPGQSPQLLISLASNRASGVPDRFSGSGSGTDFKLEISRVEAEDVGIYYCMQALQTPQTFGQGTKVEIK

SEQ ID NO: 5021 - protein, 112 aa, Artificial Sequence
  Description of Artificial Sequence: Synthetic light chain variable domain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPQTFGQGTKLEIK

SEQ ID NO: 5022 - protein, 112 aa, Artificial Sequence
  Description of Artificial Sequence: Synthetic light chain variable domain
DIVMTQSPLSLPVTPGEPASISCRSSQSLLHSNGYKYLDWYLQKPGQSPQLLIYLGSNRASGVPDRFSGSGSGTDFTLKISRVEAEDVGVYYCMQALQTPQTFGQGTKLEIK

SEQ ID NO: 5023 - protein, 112 aa, Artificial Sequence
  Description of Artificial Sequence: Synthetic light chain variable domain
DIVMTQSPLSLPVTPGEPASISCRSSQSLLHSNGYNFLDWYLQKPGQSPQVLIYLGSNRASGVPDRFSGSGSGTDFTLKISRVEAEDVGVYYCMQALQTPQTFGQGTKLEIK

SEQ ID NO: 5024 - protein, 112 aa, Artificial Sequence
  Description of Artificial Sequence: Synthetic light chain variable domain
DIVMTQSPLSLPATPGEPASISCRSSQSLLHSNGYTYLDWYLQKPGQSPQVLIYLASNRASGVPDRFSGSGSGTNFTLKISRVEAEDVGLFYCMQALQTPQTFGQGTKLEIK

SEQ ID NO: 5025 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPLTFGGGTKVEIK

SEQ ID NO: 5026 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCTQATQFPITFGPGTKVDIK

SEQ ID NO: 5027 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCTQATQFPLTFGGGTKVEIK

SEQ ID NO: 5028 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFRGSGAGTDFTLKISRVEAEDVGVYYCTQATQFPLTFGGGTKVEIK

SEQ ID NO: 5029 - protein, 112 aa, Artificial Sequence
  Description of Artificial Sequence: Synthetic light chain variable domain
DVVMTQSPLSLPVTLGQPASISCRSSQSLVYSDGNTYLNWFQQRPGQSPRRLIYTVSNRDSGVPDRFSGSGSGTDFTLKISRVEAEDVGVYYCMQGTHWPWTFGQGTKVEIK

SEQ ID NO: 5030 - protein, 112 aa, Artificial Sequence
  Description of Artificial Sequence: Synthetic light chain variable domain
DVVMTQSPLSLPVTLGQPASISCRSSQSLVYSDANRYLNWFQQRPGQSPRRLIYKVSSRDSGVPDRFSGSGSDTDFTLKISRVEAEDVGVCDCMQGTHWPWTFGQGTKVEIK

SEQ ID NO: 5031 - protein, 112 aa, Artificial Sequence
  Description of Artificial Sequence: Synthetic light chain variable domain
DVVMTQSPLSLPVTPGEPASISCRSSQSLLHSNAYNYLDWYLQKPGQSPQLLIYLGSNRASGVPDRFSGSGSGTDFTLKISRVEADDVGVYYCMQGTHWPWTFGQGTKVEIK

SEQ ID NO: 5032 - protein, 112 aa, Artificial Sequence
  Description of Artificial Sequence: Synthetic light chain variable domain
DVVMTQSPLSLPVTLGQPASISCRSSQSLVYSDGNTYLNWFQQRPGQSPRRLIYQVSNRDSGVPDRFSGSGSGTDFTLKIGRVEAEDVGVYFCMQGTHWPWTFGQGTKVEIK

SEQ ID NO: 5033 - protein, 112 aa, Artificial Sequence
  Description of Artificial Sequence: Synthetic light chain variable domain
DIVMTQTPPSLPVNPGEPASISCRSSQSLLHSNGYTYLHWYLQKPGQSPQLLIYRVSNHLSGVPDRFSGSGSGSDFTLKISWVEAEDVGVYYCMQATQFPLTFGPGTKVDIK

SEQ ID NO: 5034 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPVTFGQGTKVEIK

SEQ ID NO: 5035 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPFTFGQGTKLEIK

SEQ ID NO: 5036 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPITFGQGTRLEIK

SEQ ID NO: 5037 - protein, 112 aa, Artificial Sequence
  Description of Artificial Sequence: Synthetic light chain variable domain
DIVMTQTPLSLPVTLGQPASISCRSSQSLVRSDGNTYLSWLQQRPGQPPRLLIYKISNRFSGVPDRFSGSGAGTDFTLTISRVEAEDVGVYYCMQGTQFPLTFGGGTKVEIK

SEQ ID NO: 5038 - protein, 112 aa, Artificial Sequence
  Description of Artificial Sequence: Synthetic light chain variable domain
DIVMTQTPLSSPVTLGQPASISCRSSQSLVHSDGNTYLSWLQQRPGQPPRLLIYKISNRFSGVPDRFSGSGAGTDFTLKISRVEAEDVGLYYCLQATQFPLTFGQGTKLEIK

SEQ ID NO: 5039 - protein, 107 aa, Artificial Sequence
  Description of Artificial Sequence: Synthetic light chain variable domain
DIQMTQSSSYLSVSLGGRVTITCKASDHINNWLAWYQQKPGNAPRLLISGATSLETGVPSRFSGSGSGKDYTLSITSLQTEDVATYYCQQYWSTPFTFGSGTKLEIK

SEQ ID NO: 5040 - protein, 105 aa, Artificial Sequence
  Description of Artificial Sequence: Synthetic light chain variable domain
QSALTQPPSASGSPGQSISISCTGTSNRFVSWYQQHPGKAPKLVIYGVNKRPSGVPDRFSGSKSGNTASLTVSGLQTDDEAVYYCSSLVGNWDVIFGGGTKLTVL

SEQ ID NO: 5041 - protein, 105 aa, Artificial Sequence
  Description of Artificial Sequence: Synthetic light chain variable domain
QSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVL

SEQ ID NO: 5042 - protein, 107 aa, Artificial Sequence
  Description of Artificial Sequence: Synthetic light chain variable domain
QIVLTQSPALMSASPGEKVTMTCSASSSVSYIYWYQQKPRSSPKPWIYLTSNLASGVPARFSGSGSGTSYSLTISSMEAEDAATYYCQQWSGNPYTFGGGTKLEIKR

SEQ ID NO: 5043 - protein, 214 aa, Artificial Sequence
  Description of Artificial Sequence: Synthetic light chain variable domain
DIQMTQSPSSLSASVGDRVTITCRASENIYSYLAWYQQKPGKAPKLLIYNAKTLAEGVPSRFSGSGSGTDFTLTISSLQPEDFATYYCQHHYGTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5044 - protein, 108 aa, Artificial Sequence
  Description of Artificial Sequence: Synthetic light chain variable domain
QPVLTQPSSVSVAPGETARIPCGGDDIETKSVHWYQQKPGQAPVLVIYDDDDRPSGIPERFFGSNSGNTATLSISRVEAGDEADYYCQVWDDNNDEWVFGGGTQLTVL

SEQ ID NO: 5045 - protein, 110 aa, Artificial Sequence
  Description of Artificial Sequence: Synthetic light chain variable domain
QSALTQPASVSGSPGQSITISCSGSSSNIGNNAVNWYQQLPGKAPKLLIYYDDLLPSGVSDRFSGSKSGTSAFLAISGLQSEDEADYYCAAWDDSLNGPVFGGGTKLTVL

SEQ ID NO: 5046 - protein, 239 aa, Artificial Sequence
  Description of Artificial Sequence: Synthetic light chain variable domain
MSVPTMAWMMLLLGLLAYGSGVDSQAVVTQEPSLTVSPGGTVTLTCRSSTGAVTTSNYANWFQQKPGQAPRTLIGGTNNRAPGVPARFSGSLLGGKAALTLSGAQPEDEAEYYCALWYSNHWVFGGGTKLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 5047 - protein, 239 aa, Artificial Sequence
  Description of Artificial Sequence: Synthetic light chain variable domain
MSVPTMAWMMLLLGLLAYGSGVDSQTVVTQEPSFSVSPGGTVTLTCRSSTGAVTTSNYANWYQQTPGQAPRTLIGGTNNRAPGVPDRFSGSILGNKAALTITGAQADDESDYYCALWYSNHWVFGGGTKLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 5048 - protein, 235 aa, Artificial Sequence
  Description of Artificial Sequence: Synthetic light chain variable domain
MVLQTQVFISLLLWISGAYGDIVLTQSPATLSLSPGERATLSCRASQSVRSNYLAWYQQKPGQAPRLLIYGASSRATGVPARFSGSGSGTDFTLTISSLEPEDFAVYYCQQYSNFPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5049 - protein, 214 aa, Artificial Sequence
  Description of Artificial Sequence: Synthetic light chain variable domain
DIQMTQSPILLSASVGDRVTITCRASQDVSTAVAWYQQRTNGSPRLLIYSASFLYSGVPSRFSGSGSGTDFTLTISSLQPEDIADYYCQQFYTTPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5050 - protein, 214 aa, Artificial Sequence
  Description of Artificial Sequence: Synthetic light chain variable domain
DIQMTQSPILLSASVGDRVTITCRASQDVSTAVAWYQQRTNGSPRLLIYSASFLYSGVPSRFSGSGSGTDFTLTISSLQPEDEADYYCQQFYTTPSTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5051 - protein, 112 aa, Artificial Sequence
  Description of Artificial Sequence: Synthetic light chain variable domain
DIVMTQSPLSLPVTPGEPASISCRASKSVSSSGYSYMHWYLQKPGQSPQLLIYLASNLESGVPDRFSGSGSGTDFTLKISRVEAEDVGVYYCQHSRALPLTFGAGTKLELKR

SEQ ID NO: 5052 - protein, 112 aa, Artificial Sequence
  Description of Artificial Sequence: Synthetic light chain variable domain
DIVLTQSLASLAVSLGQRATISCRASKSVSSSGYSYMHWYQQKPGQPPKLLIYLASNLESGVPARFSGSGSGTDFTLNIHPVEEEDAATYYCQHSRALPLTFGAGTKLELKR

SEQ ID NO: 5053 - protein, 114 aa, Artificial Sequence
  Description of Artificial Sequence: Synthetic light chain variable domain
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSA

SEQ ID NO: 5054 - protein, 105 aa, Artificial Sequence
  Description of Artificial Sequence: Synthetic light chain variable domain
LIQPPSASVTLGSTVSLTCVGDELSKTYAHWYQQKPDKTIVSVIYKDSERPSGISDRFSGSSSGTTATLTIHGTLAEDEADYYCLSTYSDDNLPVFGGGTKLTVL

SEQ ID NO: 5055 - protein, 111 aa, Artificial Sequence
  Description of Artificial Sequence: Synthetic light chain variable domain
SVTSYELIQPPSASVTLENTVSITCSGDELSNKYAHWYQQKPDKTILEVMYKDSERPSGISDRFSGSSSGTTAILTIRDAQAEDEADYYCLSTYSDDDLPVFGGGTKLTVL

SEQ ID NO: 5056 - protein, 113 aa, Artificial Sequence
  Description of Artificial Sequence: Synthetic light chain variable domain
DVVMTQTPVSLPVSLGGQASISCRSSQSLIHSNGNTYLHWFLQKPGQSPQLLIYRISNRFSGVPDRFSGSGSGTDFTLKISRVESEDLGLYYCLQGTHLPFTFGSGTKLEIKR

SEQ ID NO: 5057 - protein, 119 aa, Artificial Sequence
  Description of Artificial Sequence: Synthetic light chain variable domain
EVQLVQSGADVKKPGASVKVSCKASGYTFTNYVMHWVRQAPGQGLEWLGYINPYNDGTQYNERFKGRVTMTGDTSISTAYMELSRLTSDDTAVYYCAREVYGNYIWGNWGQGTLVSVSS

SEQ ID NO: 5058 - protein, 108 aa, Artificial Sequence
  Description of Artificial Sequence: Synthetic light chain variable domain
EIVLTQSPGTLSLSPGERATLSCSASSSISSNYLHWYQQKPGQAPRLLIYRTSNLASGIPDRFSGSGSGTDFTLTISRLEPEDFAVYYCQQGSSIPFTFGQGTKLEIK

SEQ ID NO: 5059 - protein, 215 aa, Artificial Sequence
  Description of Artificial Sequence: Synthetic light chain variable domain
EIVLTQSPGTLSLSPGERATLSCSASSSISSNYLHWYQQKPGQAPRLLIYRTSNLASGIPDRFSGSGSGTDFTLTISRLEPEDFAVYYCQQGSSIPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5060 - protein, 125 aa, Artificial Sequence
  Description of Artificial Sequence: Synthetic light chain variable domain
DIQMTQSPASLSASVGETVTITCRASGNIHNYLAWYQQKQGKSPQLLVYNAKTLADGVPSRFSGSGSGTQYSLKINSLQPEDFGSYYCQHFWSTPFTFGSGTKLEIKRADAAPTVSIFPPSSKLG

SEQ ID NO: 5061 - protein, 106 aa, Artificial Sequence [sequence omitted]

SEQ ID NO: 5062 - protein, 129 aa, Artificial Sequence
  Description of Artificial Sequence: Synthetic light chain variable domain
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYDSSLTFGGGTKVEIKRT

SEQ ID NO: 5063 - protein, 214 aa, Artificial Sequence
  Description of Artificial Sequence: Synthetic light chain variable domain
DIQMTQSPSSLSASVGDRVTITCRATQSIYNALAWYQQKPGKAPKLLIYNANTLHTGVPSRFSASGSGTDSTLTISSLQPEDFATYYCQQYYDYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5064 - protein, 214 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5065 - protein, 214 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5066 - protein, 215 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5067 - protein, 107 aa, Artificial Sequence; identical to SEQ ID NO: 4138
  Description of Artificial Sequence: Synthetic light chain variable domain

SEQ ID NO: 5068 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKVEIK

SEQ ID NO: 5069 - protein, 107 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGRDFTLTISSLEPEDFAVYYCQQRSNWPWTFGQGTKVEIK

SEQ ID NO: 5070 - protein, 108 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 5071 - protein, 214 aa, Artificial Sequence
  Description of Artificial Sequence: Synthetic light chain variable domain
DIQMTQSPSSLSASVGDRVTITCRASQDISNYLNWYQQKPGKAPKLLIYYTSKLHSGVPSRFSGSGSGTDYTLTISSLQPEDFATYYCQQGSALPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5072 - protein, 107 aa, Artificial Sequence
  Description of Artificial Sequence: Synthetic light chain variable domain
EIVLTQSPATLSLSPGERATLSCRASSSVSYYLAWYQQKPGQAPRLLIYATSNRATGIPARFSGSGSGTDFTLTISSLEPEDFAVYYCQQWSSNPWTFGQGTKVEIK

SEQ ID NO: 5073 - protein, 108 aa, Artificial Sequence
  Description of Artificial Sequence: Synthetic light chain variable domain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPRITFGQGTRLEIK

SEQ ID NO: 5074 - protein, 219 aa, Artificial Sequence
  Description of Artificial Sequence: Synthetic light chain variable domain
DIVMTQSPDSLPVTPGEPASISCRSSQSLLHSNGYNYLDWYLQKAGQSPQLLIYLGSNRASGVPDRFSGSGSGTDFTLKISRVEAEDVGVYYCQQYYNHPTTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5075 - protein, 107 aa, Artificial Sequence
  Description of Artificial Sequence: Synthetic light chain variable domain
DIQMTQSPSSLSASVGDRVTITCRASQDISNYLNWYQQKPGKAVKLLIYYTSKLHSGVPSRFSGSGSRTDYTLTISSLQPEDFATYYCQQGSALPWTFGQGTKVEIK

SEQ ID NO: 5076 - protein, 214 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5077 - protein, 107 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGPGTKVDIK

SEQ ID NO: 5078 - protein, 106 aa, Artificial Sequence
  Description of Artificial Sequence: Synthetic light chain variable domain
EIVVTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 5079 - protein, 107 aa, Artificial Sequence
  Description of Artificial Sequence: Synthetic light chain variable domain
DIQMTQSPSSLSASVGDRVTITCKASQDVSTAVAWYQQKPGKAPKLLIYSASYLYTGVPSRFSGSGSGTDFTFTISSLQPEDIATYYCQQHYSTPRTFGQGTKLEIK

SEQ ID NO: 5080 - protein, 111 aa, Artificial Sequence
  Description of Artificial Sequence: Synthetic light chain variable domain
EIVLTQSPATLSLSPGERATLSCRASKSVSTSGYSYMHWYQQKPGQAPRLLIYLASNLESGVPARFSGSGSGTDFTLTISSLEPEDFAVYYCQHSRELPLTFGGGTKVEIK

SEQ ID NO: 5081 - protein, 233 aa, Artificial Sequence
  Description of Artificial Sequence: Synthetic light chain variable domain
MRPSIQFLGLLLFWLHGAQCDIQMTQSPSSLSASLGGKVTITCKSSQDINKYIAWYQHKPGKGPRLLIHYTSTLQPGIPSRFSGSGSGRDYSFSISNLEPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5082 - protein, 127 aa, Artificial Sequence
  Description of Artificial Sequence: Synthetic light chain variable domain
METPAQLLFLLLLWLPDTTGEIVLTQSPGTLSLSPGERAILSCRASQSVSSSFLAWYQQKPGQAPRLLIYGAFSRATGIPDRFSGSGSGTDFTLTISRLEPEDFAVYYCQQYDSSRTFGQGTKVEIK

SEQ ID NO: 5083 - protein, 108 aa, Artificial Sequence
  Description of Artificial Sequence: Synthetic light chain variable domain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPWTFGGGTKLEIKR

SEQ ID NO: 5084 - protein, 127 aa, Artificial Sequence
  Description of Artificial Sequence: Synthetic light chain variable domain
MEAPAQLLFLLLLWLPDTTGEIVLTQSPATLSLSPGERATLSCRASQGVSSYLAWYQQKPGQAPRLLIYDASNRATGIPARFSGSGPGTDFTLTISSLEPEDFAVYYCQQRSNWHPTFGQGTKVEIK

SEQ ID NO: 5085 - protein, 108 aa, Artificial Sequence
  Description of Artificial Sequence: Synthetic light chain variable domain
DIVMTQSHKFMSTSLGDRVSITCKASQDVGAAVAWYQQKPGQSPKLLIYWASTRHTGVPDRFTGGGSGTDFTLTISNVQSEDLTDYFCQQYINYPLTFGGGTKLEIKR

SEQ ID NO: 5086 - protein, 127 aa, Artificial Sequence
  Description of Artificial Sequence: Synthetic light chain variable domain
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 5087 - protein, 107 aa, Artificial Sequence
  Description of Artificial Sequence: Synthetic light chain variable domain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 5088 - protein, 108 aa, Artificial Sequence
  Description of Artificial Sequence: Synthetic light chain variable domain
DIQMTQSPSSLSASVGDRVTITCRASQDISNYLNWYQQKPGKAPKLLIYYTSRLHSGVPSRFSGSGSGTDYTLTISSLQPEDFATYYCQQGNTLPWTFGQGTKVEIKR

SEQ ID NO: 5089 - protein, 108 aa, Artificial Sequence
  Description of Artificial Sequence: Synthetic light chain variable domain
DIQMTQSPSSLSASVGDRVTITCRASQDISNYLNWYQQKPGKAVKLLIYYTSRLHSGVPSRFSGSGSGTDYTLTISSLQPEDFATYFCQQGNTLPWTFGQGTKVEIKR

SEQ ID NO: 5090 - protein, 108 aa, Artificial Sequence
  Description of Artificial Sequence: Synthetic light chain variable domain
DIQMTQSPSSLSASVGDRVTITCKASQDVGAAVAWYQQKPGKAPKLLIYWASTRHTGVPSRFSGSGSGTDFTLTISSLQPEDFATYYCQQYINYPLTFGGGTKVEIKR

SEQ ID NO: 5091 - protein, 108 aa, Artificial Sequence
  Description of Artificial Sequence: Synthetic light chain variable domain
DIQMTQSPSSLSASVGDRVTITCKASQDVGAAVAWYQQKPGKAPKLLIYWASTRHTGVPDRFSGGGSGTDFTLTISSLQPEDFATYYCQQYINYPLTFGGGTKVEIKR

SEQ ID NO: 5092 - protein, 120 aa, Artificial Sequence
  Description of Artificial Sequence: Synthetic light chain variable domain
EVQLVQSGGGLVHPGGSLRLSCAHSGFTFTSSAMHWVRQAPGKGLEWISAIGTGGDTYYADSVKGRFTISRDNAKNSLYLQINSLRAEDMAVYYCARDFYDILTGIFDYWGQGTLVTVSS

SEQ ID NO: 5093 - protein, 106 aa, Artificial Sequence
  Description of Artificial Sequence: Synthetic light chain variable domain
EIVLTQSPATLSLSPGERATLSCRASSSVSYMHWYQQKPGQAPRPWIYATSNRATGIPARFSGSGSGTDYTLTISSLEPEDFAVYYCQQWSSNPWTFGQGTKVEIK

SEQ ID NO: 5094 - protein, 126 aa, Artificial Sequence
  Description of Artificial Sequence: Synthetic light chain variable domain
MRPSIQFLGLLLFWLHGAQCDIQMTQSPSSLSASLGGKVTITCKSSQDINKYIAWYQHKPGKGPRLLIHYTSTLQPGIPSRFSGSGSGRDYSFSISNLEPEDIATYYCLQYDNLLTFGAGTKLELK

SEQ ID NO: 5095 - protein, 136 aa, Artificial Sequence
  Description of Artificial Sequence: Synthetic light chain variable domain
MEFVLSWVFLVAILKGVQCEIQLVQSGGGLVHPGGSLRLSCAGSGFTFSSDAMYWVRQAPGKGLEWVSAIGIGGDTYYTDSVMGRFTISRDNAKNSLYLQMNSLRAEDMAVYYCARLGMGYYFDYWGQGTLVTVSS

SEQ ID NO: 5096 - protein, 108 aa, Artificial Sequence
  Description of Artificial Sequence: Synthetic light chain variable domain
DIQMTQSPSSLSASVGDRVTITCRATQSIYNALAWYQQKPGKAPKLLIYNANTLHTGVPSRFSASGSGTDSTLTISSLQPEDFATYYCQQYYDYPLTFGGGTKVEIKR

SEQ ID NO: 5097 - protein, 117 aa, Artificial Sequence
  Description of Artificial Sequence: Synthetic light chain variable domain
EVQLVESGGGLVQPGGSLRLSCAASGFTFSSYDMHWVRQTTGKGLEWVSVIGTAGDTYYPGSVKGRFTISRENAKNSLYLQMNSLRAGDTAVYYCARGGMGNYFDYWGQGTLVTVSS

SEQ ID NO: 5098 - protein, 130 aa, Artificial Sequence
  Description of Artificial Sequence: Synthetic light chain variable domain
MDMRVLAQLLGLLLLCFPGARCDIQMTQSPSSLSASVGNRVTITCRASQDISSWLAWYQQKPEKAPKSLIYAASSLQSGVPSRFSGSGSGTDFTLTISSLQPEDFATYYCQQYNSYPLTFGQGTRLEIKR

SEQ ID NO: 5099 - protein, 106 aa, Artificial Sequence
  Description of Artificial Sequence: Synthetic light chain variable domain
QIVLTQSPAILSASPGEKVTMTCRASSSVSYMHWYQQKPGSSPKPWIYATSNLASGVPARFSGSGSGTSYSLTINRVEAEDAATYYCQQWSSNPWTFGGGTKLEIK

SEQ ID NO: 5100 - protein, 107 aa, Artificial Sequence
  Description of Artificial Sequence: Synthetic light chain variable domain
EIVLTQSPATLSLSPGERATLSCRASSSVSYYMAWYQQKPGQAPRLLIYATSNRATGIPARFSGSGSGTDFTLTISSLEPEDFAVYYCQQWSSNPWTFGQGTKVEIK

SEQ ID NO: 5101 - protein, 107 aa, Artificial Sequence
  Description of Artificial Sequence: Synthetic light chain variable domain
EIVLTQSPATLSLSPGERATLSCRASSSVSYYLAWYQQKPGQAPRLLIYATSNRATGIPARFSGSGSGTDYTLTISSLEPEDFAVYYCQQWSSNPWTFGQGTKVEIK

SEQ ID NO: 5102 - protein, 107 aa, Artificial Sequence
  Description of Artificial Sequence: Synthetic light chain variable domain
EIVLTQSPATLSLSPGERATLSCRASSSVSYYMAWYQQKPGQAPRLLIYATSNRATGIPARFSGSGSGTDYTLTISSLEPEDFAVYYCQQWSSNPWTFGQGTKVEIK

SEQ ID NO: 5103 - protein, 107 aa, Artificial Sequence
  Description of Artificial Sequence: Synthetic light chain variable domain
EIVLTQSPATLSLSPGERATLSCRASSSVSYYMAWYQQKPGQAPRPWIYATSNRATGIPARFSGSGSGTDYTLTISSLEPEDFAVYYCQQWSSNPWTFGQGTKVEIK

SEQ ID NO: 5104 - protein, 115 aa, Artificial Sequence
  Description of Artificial Sequence: Synthetic light chain variable domain
QVQLVESGGGVVQPGRSLRLSCAASGFTFSNYALHWVRQAPGKGLEWVALISYDGSRKHYADSVKGRFSISRDNSKNTLYLQMNSLRAEDTAVYYCASLTMVREGGQGTLVTVSS

SEQ ID NO: 5105 - protein, 107 aa, Artificial Sequence
  Description of Artificial Sequence: Synthetic light chain variable domain
QIVLTQSPATLSLSPGERATLSCRASSSVSYYMAWYQQKPGQAPRPWIYATSNRATGIPARFSGSGSGTDYTLTISSLEPEDFAVYYCQQWSSNPWTFGQGTKVEIK

SEQ ID NO: 5106 - protein, 106 aa, Artificial Sequence
  Description of Artificial Sequence: Synthetic light chain variable domain
EIVLTQSPATLSLSPGERATLSCRASSSVSYMAWYQQKPGQAPRLLIYATSNRATGIPARFSGSGSGTDYTLTISSLEPEDFAVYYCQQWSSNPWTFGQGTKVEIK

SEQ ID NO: 5107 - protein, 107 aa, Artificial Sequence
  Description of Artificial Sequence: Synthetic light chain variable domain
DIQLTQSPSSLSASVGDRVTITCRVSQGISSYLNWYRQKPGKVPKLLIYSASNLQSGVPSRFSGSGSGTDFTLTISSLQPEDVATYYGQRTYNAPYTFGGGTKVEIK

SEQ ID NO: 5108 - protein, 106 aa, Artificial Sequence
  Description of Artificial Sequence: Synthetic light chain variable domain
EIVLTQSPATLSLSPGERATLSCRASSSVSYMHWYQQKPGQAPRLLIYATSNRATGIPARFSGSGSGTDYTLTISSLEPEDFAVYYCQQWSSNPWTFGQGTKVEIK

SEQ ID NO: 5109 - protein, 106 aa, Artificial Sequence
  Description of Artificial Sequence: Synthetic light chain variable domain
EIVLTQSPATLSLSPGERATLSCRASSSVSYMAWYQQKPGQAPRLLIYATSNLASGIPARFSGSGSGTDYTLTISSLEPEDFAVYYCQQWSSNPWTFGQGTKVEIK

SEQ ID NO: 5110 - protein, 106 aa, Artificial Sequence
  Description of Artificial Sequence: Synthetic light chain variable domain
EIVLTQSPATLSLSPGERATLSCRASSSVSYMHWYQQKPGQAPRLLIYATSNLASGIPARFSGSGSGTDYTLTISSLEPEDFAVYYCQQWSSNPWTFGQGTKVEIK

SEQ ID NO: 5111 - protein, 107 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGGGTKVEIK

SEQ ID NO: 5112 - protein, 214 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5113 - protein, 113 aa, Artificial Sequence
  Description of Artificial Sequence: Synthetic light chain variable domain
DIVMTQSPDSLAVSLGERATINCKSSQSLWDSGNQKNFLTWYQQKPGQPPKLLIYWTSTRESGVPDRFSGSGSGTDFTLTISSLQAEDVAVYYCQNDYFYPLTFGGGTKVEIK

SEQ ID NO: 5114 - protein, 107 aa, Artificial Sequence [sequence omitted]

SEQ ID NO: 5115 - protein, 111 aa, Artificial Sequence
  Description of Artificial Sequence: Synthetic light chain variable domain
DIVLTQSPASLTLSPGQRLTISCRASQSVSTSGYSYMHWYQQKPDQSPKLLIKFGSNLESGIPARFSGSGSGTDFTLTISSLEEEDFATYYCQHSWEIPYTFGQGTKLEIK

SEQ ID NO: 5116 - protein, 111 aa, Artificial Sequence
  Description of Artificial Sequence: Synthetic light chain variable domain
DIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 5117 - protein, 111 aa, Artificial Sequence
  Description of Artificial Sequence: Synthetic light chain variable domain
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 5118 - protein, 111 aa, Artificial Sequence
  Description of Artificial Sequence: Synthetic light chain variable domain
DIVLTQSPATLSLSPGQRLTISCRASQSVSTSGYSYMHWYQQKPDQSPKLLIKFGSNLESGIPARFSGSGSGTDFTLTISSLEPEDFAVYYCQHSWEIPYTFGQGTKLEIK

SEQ ID NO: 5119 - protein, 221 aa, Artificial Sequence
  Description of Artificial Sequence: Synthetic light chain variable domain
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIKRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5120 - protein, 113 aa, Artificial Sequence
  Description of Artificial Sequence: Synthetic light chain variable domain
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIK

SEQ ID NO: 5121 - protein, 113 aa, Artificial Sequence
  Description of Artificial Sequence: Synthetic light chain variable domain
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIK

SEQ ID NO: 5122 - protein, 113 aa, Artificial Sequence
  Description of Artificial Sequence: Synthetic light chain variable domain
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 5123 - protein, 113 aa, Artificial Sequence
  Description of Artificial Sequence: Synthetic light chain variable domain
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 5124 - protein, 113 aa, Artificial Sequence
  Description of Artificial Sequence: Synthetic light chain variable domain
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 5125 - protein, 113 aa, Artificial Sequence
  Description of Artificial Sequence: Synthetic light chain variable domain
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 5126 - protein, 113 aa, Artificial Sequence
  Description of Artificial Sequence: Synthetic light chain variable domain
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPLTFGGGTKVEIK

SEQ ID NO: 5127 - protein, 113 aa, Artificial Sequence
  Description of Artificial Sequence: Synthetic light chain variable domain
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 5128 - protein, 113 aa, Artificial Sequence
  Description of Artificial Sequence: Synthetic light chain variable domain
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIK

SEQ ID NO: 5129 - protein, 113 aa, Artificial Sequence
  Description of Artificial Sequence: Synthetic light chain variable domain
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 5130 - protein, 113 aa, Artificial Sequence
  Description of Artificial Sequence: Synthetic light chain variable domain
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 5131 - protein, 113 aa, Artificial Sequence
  Description of Artificial Sequence: Synthetic light chain variable domain
DIVMTQSPDSLAVSLGERATINCKSSQSLWDSTNQKNFLTWYQQKPGQPPKLLIYWTSTRESGVPDRFSGSGSGTDFTLTISSLQAEDVAVYYCQNDYFYPLTFGGGTKVEIK

SEQ ID NO: 5132 - protein, 214 aa, Artificial Sequence
  Description of Artificial Sequence: Synthetic light chain variable domain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5133 - protein, 214 aa, Artificial Sequence; identical to SEQ ID NO: 5132
  Description of Artificial Sequence: Synthetic light chain variable domain

SEQ ID NO: 5134 - protein, 218 aa, Artificial Sequence
  Description of Artificial Sequence: Synthetic light chain variable domain
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5135 - protein, 218 aa, Artificial Sequence; identical to SEQ ID NO: 5134
  Description of Artificial Sequence: Synthetic light chain variable domain

SEQ ID NO: 5136 - protein, 219 aa, Artificial Sequence
  Description of Artificial Sequence: Synthetic light chain variable domain
DVVMTQSPLSLPVPLGQPASISCRSSQSLVDNDGNTYLNWFQQRPGQSPRRLIYKVSMRDSGVPDRFTGSGSGTDFTLRISRVEADDVGVYYCMQGTHWPLTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5137 - protein, 107 aa, Artificial Sequence
  Description of Artificial Sequence: Synthetic light chain variable domain
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIK

SEQ ID NO: 5138 - protein, 107 aa, Artificial Sequence
  Description of Artificial Sequence: Synthetic light chain variable domain
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIK

SEQ ID NO: 5139 - protein, 214 aa, Artificial Sequence
  Description of Artificial Sequence: Synthetic light chain variable domain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5140 - protein, 107 aa, Artificial Sequence
  Description of Artificial Sequence: Synthetic light chain variable domain
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 5141 - protein, 107 aa, Artificial Sequence
  Description of Artificial Sequence: Synthetic light chain variable domain
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 5142 - protein, 107 aa, Artificial Sequence
  Description of Artificial Sequence: Synthetic light chain variable domain
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 5143 - protein, 107 aa, Artificial Sequence
  Description of Artificial Sequence: Synthetic light chain variable domain
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 5144 - protein, 108 aa, Artificial Sequence
  Description of Artificial Sequence: Synthetic light chain variable domain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 5145 - protein, 107 aa, Artificial Sequence
  Description of Artificial Sequence: Synthetic light chain variable domain
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIK

SEQ ID NO: 5146 - protein, 122 aa, Artificial Sequence; identical to SEQ ID NO: 2651
  Description of Artificial Sequence: Synthetic light chain variable domain

SEQ ID NO: 5147 - protein, 107 aa, Artificial Sequence
  Description of Artificial Sequence: Synthetic light chain variable domain
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 5148 - protein, 107 aa, Artificial Sequence
  Description of Artificial Sequence: Synthetic light chain variable domain
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 5149 - protein, 108 aa, Artificial Sequence; identical to SEQ ID NO: 5144
  Description of Artificial Sequence: Synthetic light chain variable domain

SEQ ID NO: 5150 - protein, 215 aa, Artificial Sequence
  Description of Artificial Sequence: Synthetic light chain variable domain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFCGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5151 - protein, 107 aa, Artificial Sequence
  Description of Artificial Sequence: Synthetic light chain variable domain
DIMMTQSHKFMSTSVGDRVSITCKASQDVGTAVAWYQQKPGQSPKLLIYWASTRHTGVPDRFTGSGSGTDFTLTISNVQSEDLADYFCQQYNSYPLTFGQGTKVEIK

SEQ ID NO: 5152 - protein, 107 aa, Artificial Sequence; identical to SEQ ID NO: 5137
  Description of Artificial Sequence: Synthetic light chain variable domain

SEQ ID NO: 5153 - protein, 214 aa, Artificial Sequence
  Description of Artificial Sequence: Synthetic light chain variable domain
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5154 - protein, 107 aa, Artificial Sequence
  Description of Artificial Sequence: Synthetic light chain variable domain
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGSKLELK

SEQ ID NO: 5155 - protein, 107 aa, Artificial Sequence; identical to SEQ ID NO: 5138
  Description of Artificial Sequence: Synthetic light chain variable domain

SEQ ID NO: 5156 - protein, 214 aa, Artificial Sequence
  Description of Artificial Sequence: Synthetic light chain variable domain
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5157 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 5158 - protein, 263 aa, Artificial Sequence [sequence omitted]

SEQ ID NO: 5159 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQYGRNPPTFGQGTKLEIK

SEQ ID NO: 5160 - protein, 107 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQYGVYPFTFGQGTKLEIK

SEQ ID NO: 5161 - protein, 127 aa, Artificial Sequence
  Description of Artificial Sequence: Synthetic light chain variable domain
DIQMTQSPASLSASVGDTVTITCRASENIYSFLAWYHQKQGRSPQLLVYHAKTLAEGVPSRFSGSGSGTQFSLKINSLQAEDFGSYYCQHYYGSPLTFGAGTKLEVKRADAAPTVSIFPPSSEELSL

SEQ ID NO: 5162 - protein, 107 aa, Artificial Sequence; identical to SEQ ID NO: 5140
  Description of Artificial Sequence: Synthetic light chain variable domain

SEQ ID NO: 5163 - protein, 214 aa, Artificial Sequence
  Description of Artificial Sequence: Synthetic light chain variable domain
AIQLTQSPSSLSASVGDRVTITCRPSQGINWELAWYQQKPGKAPKLLIYDASSLEQGVPSRFSGSGSGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5164 - protein, 110 aa, Artificial Sequence
  Description of Artificial Sequence: Synthetic light chain variable domain
DIVLTQSPATLSLSPGERATLSCRASQFISSSYLSWYQQKPGQAPRLLIYGSSSRATGVPARFSGSGSGTDFTLTISSLEPEDFAVYYCQQLYSSPMTFGQGTKVEIKRT

SEQ ID NO: 5165 - protein, 215 aa, Artificial Sequence
  Description of Artificial Sequence: Synthetic light chain variable domain
DIVLTQSPATLSLSPGERATLSCRASQFISSSYLSWYQQKPGQAPRLLIYGSSSRATGVPARFSGSGSGTDFTLTISSLEPEDFAVYYCQQLYSSPMTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5166 - protein, 214 aa, Artificial Sequence
  Description of Artificial Sequence: Synthetic light chain variable domain
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5167 - protein, 107 aa, Artificial Sequence; identical to SEQ ID NO: 5141
  Description of Artificial Sequence: Synthetic light chain variable domain

SEQ ID NO: 5168 - protein, 214 aa, Artificial Sequence
  Description of Artificial Sequence: Synthetic light chain variable domain
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5169 - protein, 107 aa, Artificial Sequence; identical to SEQ ID NO: 5142
  Description of Artificial Sequence: Synthetic light chain variable domain

SEQ ID NO: 5170 - protein, 214 aa, Artificial Sequence
  Description of Artificial Sequence: Synthetic light chain variable domain
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5171 - protein, 107 aa, Artificial Sequence; identical to SEQ ID NO: 5143
  Description of Artificial Sequence: Synthetic light chain variable domain

SEQ ID NO: 5172 - protein, 214 aa, Artificial Sequence
  Description of Artificial Sequence: Synthetic light chain variable domain
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5173 - protein, 107 aa, Artificial Sequence; identical to SEQ ID NO: 5145
  Description of Artificial Sequence: Synthetic light chain variable domain

SEQ ID NO: 5174 - protein, 214 aa, Artificial Sequence
  Description of Artificial Sequence: Synthetic light chain variable domain
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5175 - protein, 107 aa, Artificial Sequence
  Description of Artificial Sequence: Synthetic light chain variable domain
DIVMTQSHKFMSTSVGDRVSITCKASQDVGTAVAWYQQKPGQSPKLLIYWASTRHTGVPDRFTGSGSGTDFTLTISNVQSEDLADYFCQQYNSYPLTFGAGSKLELK

SEQ ID NO: 5176 - protein, 107 aa, Artificial Sequence; identical to SEQ ID NO: 5147
  Description of Artificial Sequence: Synthetic light chain variable domain

SEQ ID NO: 5177 - protein, 214 aa, Artificial Sequence
  Description of Artificial Sequence: Synthetic light chain variable domain
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5178 - protein, 107 aa, Artificial Sequence; identical to SEQ ID NO: 5148
  Description of Artificial Sequence: Synthetic light chain variable domain

SEQ ID NO: 5179 - protein, 214 aa, Artificial Sequence
  Description of Artificial Sequence: Synthetic light chain variable domain
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5180 - protein, 114 aa, Artificial Sequence
  Description of Artificial Sequence: Synthetic light chain variable domain
QVQLVQSGAEVKKPGASVKVSCKASGYTFTGYTMHWVRQAPGQGLEWIGYINPRSGYTEYNQKFKDRTTITADKSTSTAYMELSSLRSEDTAVYYCARPWFAYWGQGTLVTVSS

SEQ ID NO: 5181 - protein, 113 aa, Artificial Sequence
  Description of Artificial Sequence: Synthetic light chain variable domain
DIVMTQSPASLTVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 5182 - protein, 113 aa, Artificial Sequence
  Description of Artificial Sequence: Synthetic light chain variable domain
DIVMTQSPASLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 5183 - protein, 113 aa, Artificial Sequence
  Description of Artificial Sequence: Synthetic light chain variable domain
DIVMTQSPAFLSVTPGEKVTITCKSSQSLLNSGNQKNYLTWYQQKPGQPPKLLIYWASTRESGVPDRFTGSGSGTDFTLTISSLQAEDVAVYYCQNDYSYPLTFGQGTKLEIK

SEQ ID NO: 5184 - protein, 113 aa, Artificial Sequence
  Description of Artificial Sequence: Synthetic light chain variable domain
DIVMTQSPAFLSVTPGEKVTITCKSSQSLLNSGNQKNYLTWYQQKPGQPPKLLIYWASTRESGVPDRFSGSGSGTDFTLTISSLQAEDVAVYYCQNDYSYPLTFGQGTKLEIK

SEQ ID NO: 5185 - protein, 110 aa, Artificial Sequence
  Description of Artificial Sequence: Synthetic light chain variable domain
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVL

SEQ ID NO: 5186 - protein, 110 aa, Artificial Sequence
  Description of Artificial Sequence: Synthetic light chain variable domain
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVL

SEQ ID NO: 5187 - protein, 112 aa, Artificial Sequence
  Description of Artificial Sequence: Synthetic light chain variable domain
DTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIK

SEQ ID NO: 5188 - protein, 112 aa, Artificial Sequence
  Description of Artificial Sequence: Synthetic light chain variable domain
DTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIK

SEQ ID NO: 5189 - protein, 112 aa, Artificial Sequence
  Description of Artificial Sequence: Synthetic light chain variable domain
DTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIK

SEQ ID NO: 5190 - protein, 112 aa, Artificial Sequence
  Description of Artificial Sequence: Synthetic light chain variable domain
EVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIK

SEQ ID NO: 5191 - protein, 117 aa, Artificial Sequence
  Description of Artificial Sequence: Synthetic light chain variable domain
QVQLVQSGAEVRKPGASVKVSCKASGGTFSSYAISWVRQAPGQGLEWMGRIIPILGIANYAQKFQGRVTITADKSTSTAYMELSSLRSEDTAVYYCARHYGQWWDYWGQGTLVTVSS

SEQ ID NO: 5192 - protein, 116 aa, Artificial Sequence
  Description of Artificial Sequence: Synthetic light chain variable domain
QVQLVQSGAEVKKPGSSVKVSCKASGGTFSSHPISWVRQAPGQGLEWMGRIIPMLDIPNNAQKFQGRVTITADKSTDTAYLELSSLTSEDTAVYYCARGLYYYDYWGQGTLVTVSS

SEQ ID NO: 5193 - protein, 116 aa, Artificial Sequence
  Description of Artificial Sequence: Synthetic light chain variable domain
EVQLVESGAEVKKPGSSVKVSCKASGGTFSSYAISWVRQAPGQGLEWMGRIIPIFGIANYAQKFQGRVTITADKSTSTAYMELSSLRSEDTAVYYCARSMWYMDSWGQGTLVTVSS

SEQ ID NO: 5194 - protein, 118 aa, Artificial Sequence
  Description of Artificial Sequence: Synthetic light chain variable domain
QVQLVQSGAEVKKPGASVKVSCKASGYTFSSYGISWVRQAPGQGLEWMGWISPYNGNTNYAQNLQGRVTMTTDTSTTTAYMELRSLTSDDTAVYYCARYSGYYYVDYWGQGTLVTVSS

SEQ ID NO: 5195 - protein, 119 aa, Artificial Sequence
  Description of Artificial Sequence: Synthetic light chain variable domain
EVQLVESGAEVKKPGSSVKVSCKASGGTFSSYAISWVRQAPGQGLEWMGRIIPILGIANYAQKFQGRVTITADKSTSTAYMELSSLRSEDTAVYYCARQGYVWSEMDFWGQGTLVTVSS

SEQ ID NO: 5196 - protein, 117 aa, Artificial Sequence
  Description of Artificial Sequence: Synthetic light chain variable domain
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCAAGSYYSLDIWGQGTMVTVSS

SEQ ID NO: 5197 - protein, 117 aa, Artificial Sequence
  Description of Artificial Sequence: Synthetic light chain variable domain
EVQLVQSGAEVEKPGASVKVSCKASGYTFSSYYMDWVRQAPGQGLEWMGRINPTSGSTTYAQKFQGRVTMTRDTSTFTVYMDLSSLRSEDTAVYYCARSGGGYGDSWGQGTLVTVSS

SEQ ID NO: 5198 - protein, 216 aa, Artificial Sequence
  Description of Artificial Sequence: Synthetic light chain variable domain
EIVLTQSPIIIVISASPGEKVTMTCSASSSVSYMEIWYQQRTNGSPRRWIYDTSKLASGVPARFSGSGSGTSYSLTISSMEAEDIADYFCHQWRSNPYTFGGGTKLEIKRADAAPTVSIFPPSSEQLTSGGASVVCFLNNFYPKEINVKWKIDGSERQNGVLNSWTDQDSKDSTYSMSSTLTLTKDEYERHNSYTCEATHKTSTSPIVKSFNRNEC

SEQ ID NO: 5199 - protein, 215 aa, Artificial Sequence
  Description of Artificial Sequence: Synthetic light chain variable domain
EIVLTQSPIIIVISASPGEKVTMTCSASSSVSYMHWYQQRTNGSPRRWIYDTSKLASGVPARFSGSGSGTSYSLTISSMEAEDEADYFCHQWRSNPYTFGGGTKLEIKRADAAPTVSIFPPSSEQLTSGGASVVCFLNNFYPKEINVKWKIDGSERQNGVLNSWTDQDSKDSTYSMSSTLTLTKDEYERHNSYTCEATHKTSTSPIVKSFNRNEC

SEQ ID NO: 5200 - protein, 115 aa, Artificial Sequence
  Description of Artificial Sequence: Synthetic light chain variable domain
DIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDP

SEQ ID NO: 5201 - protein, 64 aa, Artificial Sequence
  Description of Artificial Sequence: Synthetic light chain variable domain
DIVLTQSPASLAVSLGQRATISCRASESVDSFGNSFMHWYQQKPGQPPKLLIYAASNLGSGVPA

SEQ ID NO: 5202 - protein, 108 aa, Artificial Sequence
  Description of Artificial Sequence: Synthetic light chain variable domain
DIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKR

SEQ ID NO: 5203 - protein, 94 aa, Artificial Sequence
  Description of Artificial Sequence: Synthetic light chain variable domain
LGGRVTITCKASDHINNWLAWYQQKPGNAPRLLISGATTLETGVPSRFSGSGSGKDYTLSITSLQTEDVATYYCQQYWSIPYTFGGGTKLEIKR

SEQ ID NO: 5204 - protein, 108 aa, Artificial Sequence
  Description of Artificial Sequence: Synthetic light chain variable domain
DIVLTQSPATLSVTPGDSVSLSCRASQSVSNNLHWYQQKSHASPRLLIKYASQSISGIPSRFSGSGSGTDFTLSINSVETEDFGMYFCQQSYSWPRTFGGGTKLEIKR

SEQ ID NO: 5205 - protein, 114 aa, Artificial Sequence
  Description of Artificial Sequence: Synthetic light chain variable domain
DIVMTQSPSSLSVSAGEKVTMSCKSSQSLLNGGNQQNSLAWYQQKPGQPPKLLIYGASTRESGVPDRFTGSGSGTDFALTISSVQAEDLAVYYCQNDHTYPYTFGGGTELEIKR

SEQ ID NO: 5206 - protein, 116 aa, Artificial Sequence
  Description of Artificial Sequence: Synthetic light chain variable domain
DIQMTQSPASLSASVGETVTITCRTSENIYSYLAWYQQKQLAWYQQKQGKSPQLLVHNANTLAEGVPSRFSGSGSGTQFSLRINSLQPEDFGSYYCQHHYGIPFTFGGGTKLEVER

SEQ ID NO: 5207 - protein, 111 aa, Artificial Sequence
  Description of Artificial Sequence: Synthetic light chain variable domain
DIVLTQSPASLAVSLGQRATVFCRASQTVDYNGMSYMHWFQQKPGQPPKLLIYAASNLDSGIPARFSGSGSGTDFTLNIHPVEEEDAATYYCQQCIEDPLTFGAGTMLEVK

SEQ ID NO: 5208 - protein, 107 aa, Artificial Sequence
  Description of Artificial Sequence: Synthetic light chain variable domain
DIQMTQSPASLSVSVGETVTITCRASENIYSNLAWYQQKQGKSPQLLVNAATNLADGVSSRFRGSGSGTQYSLKINSLQSEDFGSYYCQHFWITPFTFGSGTKLERK

SEQ ID NO: 5209 - protein, 111 aa, Artificial Sequence
  Description of Artificial Sequence: Synthetic light chain variable domain
DIVLTQSPASLAVSLGQRATISCRASESVDNYGISFMHWFQQKPGQPPKLLIYAASNLGSGVPARFSGSGSGTDFSLNIHPLEEADTAMYFCQQSKEVPRTFGGGTKLEIK

SEQ ID NO: 5210 - protein, 108 aa, Artificial Sequence
  Description of Artificial Sequence: Synthetic light chain variable domain
SIVLTQSLKFLLVSAGDRVTMTCKASQSVTNDVAWYQQKPGQSPKLLIYYASKHYTGVPDRFTGSGYGTDFTFTISTVQAEDLAVYFCQQDYSSPYTFGGGTKLEIKR

SEQ ID NO: 5211 - protein, 111 aa, Artificial Sequence
  Description of Artificial Sequence: Synthetic light chain variable domain
DIVLTQSPASLAVSLGQRATISCRASQSVSTSTSIYMHWYQQKPGQPPKLLIKYASNLESGVPARFSGSGSGTEITLNIHPVEEEDTATYYCQHSWEIPWTFGGGTKLEIK

SEQ ID NO: 5212 - protein, 114 aa, Artificial Sequence
  Description of Artificial Sequence: Synthetic light chain variable domain
DIVMTQSPSSLSVSAGEKVTMSCKSSQSLLNSGNPKNYLAWYQQKPGQPPKLLIYGASTRGSGVPDRFTGSGSGTDFTLTISSVQAEDLAVYYCQNDHTFPYTFGGGTKLEIKR

SEQ ID NO: 5213 - protein, 107 aa, Artificial Sequence
  Description of Artificial Sequence: Synthetic light chain variable domain
DIQMTQTPSSLSASLGDRVTINCRASQGLSNYLNWYQQKPDGTVKLLIYYASILHSGVPSRFTGSGSGTDYSLTISTLEQEDIGTYFCQQGNTLPWTFGGGTKLEIK

SEQ ID NO: 5214 - protein, 113 aa, Artificial Sequence
  Description of Artificial Sequence: Synthetic light chain variable domain
DIVMSQSPSSLAVSVGEKVTLSCKSSQSLLYSSTQNNYLAWYQQTPGQSPKLLIYWASTRESGVPDRFTGSGSGTDFTLTISSVKAEDLAVYYCQQYYSYPWTFGGGTKLEIK

SEQ ID NO: 5215 - protein, 107 aa, Artificial Sequence
  Description of Artificial Sequence: Synthetic light chain variable domain
DIKMTQSPSSMYASLGERVTITCKASQDIYPYLNWFQQKPGKSPKTLIYRTNRLLDGVPSRFSGSGSGQDYSLTISSLDYEDMGIYYCLQYDEFPLTFGAGTKLELK

SEQ ID NO: 5216 - protein, 111 aa, Artificial Sequence
  Description of Artificial Sequence: Synthetic light chain variable domain
DIVLTQSPASLAVSLGQRATISCRASESVDSYGKSFMHWYQQRPGQPPKLLIYRASNLESGIPARFSGSGSRTDFTLTINPVEADDVATYYCQQSNEDPWTFGGGTKLEIK

SEQ ID NO: 5217 - protein, 111 aa, Artificial Sequence
  Description of Artificial Sequence: Synthetic light chain variable domain
DIALTQSPASLAVSLGQRATISCRASESVDNSGICFVNWFQQKPGQPPKLLIYAASNQGSGVPARFSGSGSGTDFSLNIHPMEKDDTAMYFCQQSKEVPWTFGGGTKLEIK

SEQ ID NO: 5218 - protein, 111 aa, Artificial Sequence
  Description of Artificial Sequence: Synthetic light chain variable domain
DIVLTQSPASLTVSLGQRATISCRASQSVSTSTFNYMNWYQQKLGQPPKLLIKYASNLESGVPARFSGSGSGTDFTLNIHPVEEEDIATYYCQHSWEIPWTFGGGTKLEIK

SEQ ID NO: 5219 - protein, 113 aa, Artificial Sequence
  Description of Artificial Sequence: Synthetic light chain variable domain
DIVLTQATPSVPVTPGESVSISCRSSKSLLHTKGDTYLYWFLQRPGQSPQLLIYRMSNLASGVPDRFSGSGSGTVFTLRISRVEAEDVGVYYCMQHLEYPFTFGSGTKLEIKR

SEQ ID NO: 5220 - protein, 107 aa, Artificial Sequence
  Description of Artificial Sequence: Synthetic light chain variable domain
ETTVTQSPASLSMAIGEKVTIRCITNTDIDDDMNWYQQKPGEPPKLLISEGNGLRPGVPSRFSSSGYGTDFVFTIENMLSEDVADYYCLQSDNLPLTFGSGTKLEIK

SEQ ID NO: 5221 - protein, 113 aa, Artificial Sequence
  Description of Artificial Sequence: Synthetic light chain variable domain
DIVMTQSPSSLTVTAGVKVTMSCKSSQSLLNSGDQKNCLTWYQQKPGQPPKLLIYWASTRESGVPDRFTGSGSGTDFTLTISSVQAEDLAVYYCQNDYSYPLTFGAGTKLELK

SEQ ID NO: 5222 - protein, 103 aa, Artificial Sequence
  Description of Artificial Sequence: Synthetic light chain variable domain
DIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKR

SEQ ID NO: 5223 - protein, 112 aa, Artificial Sequence
  Description of Artificial Sequence: Synthetic light chain variable domain
EIVLTQSPATLSLSPGERATLSCRASESVDSYGKSFMHWYQQKPGQAPRLLIYRASNLESGIPARFSGSGSGTDFTLTISSLEPEDFAVYYCQQSNEDPWTFGGGTKLEIKR

SEQ ID NO: 5224 - protein, 113 aa, Artificial Sequence
  Description of Artificial Sequence: Synthetic light chain variable domain
DIVMTQSPLSLPVTPGEPASISCRSSKSLLHTKGDTYLYWFLQKPGQSPQLLIYRMSNRASGVPDRFSGSGSGTDFTLKISRVEAEDVGVYYCMQHLEYPFTFGQGTKLEIKR

SEQ ID NO: 5225 - protein, 108 aa, Artificial Sequence
  Description of Artificial Sequence: Synthetic light chain variable domain
ETTLTQSPAFMSATPGDKVNISCITNTDIDDDMNWYQQKPGEAAILLISEGNGLRPGIPPRFSGSGYGTDFTLTINNIESEDAAYYFCLQSDNLPLTFGSGTKLEIKR

SEQ ID NO: 5226 - protein, 107 aa, Artificial Sequence
  Description of Artificial Sequence: Synthetic light chain variable domain
DIQMTQSPSSLSASVGDRVTITCKASQDIYPYLNWFQQKPGKAPKTLIYRTNRLLDGVPSRFSGSGSGTDFTFTISSLQPEDIATYYCLQYDEFPLTFGAGTKLEIK

SEQ ID NO: 5227 - protein, 111 aa, Artificial Sequence
  Description of Artificial Sequence: Synthetic light chain variable domain
EIVLTQSPATLSLSPGERATLSCRASESVDSYGKSFMHWYQQKPGQAPRLLIYRASNLESGIPARFSGSGSGTDFTLTISSLEPEDFAVYYCQQSNEDPWTFGGGTKLEIK

SEQ ID NO: 5228 - protein, 107 aa, Artificial Sequence
  Description of Artificial Sequence: Synthetic light chain variable domain
ETTLTQSPAFMSATPGDKVNISCITNTDIDDDMNWYQQKPGEAAILLISEGNGLRPGIPPRFSGSGYGTDFTLTINNIESEDAAYYFCLQSDNLPLTFGSGTKLEIK

SEQ ID NO: 5229 - protein, 112 aa, Artificial Sequence
  Description of Artificial Sequence: Synthetic light chain variable domain
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVTVLG

SEQ ID NO: 5230 - protein, 111 aa, Artificial Sequence
  Description of Artificial Sequence: Synthetic light chain variable domain
QSVVTQPPSVSAAPGQKVTISCSGSSSNIENNYVSWYQQLPGTAPKLLIYDNNKRPSGIPDRFSGSKSGTSATLGITGLQTGDEADYYCGTWDSSLSAYVFGTGTKVTVLG

SEQ ID NO: 5231 - protein, 111 aa, Artificial Sequence
  Description of Artificial Sequence: Synthetic light chain variable domain
QSVVTQPPSVSAAPGQKVTISCSGSSSNIGNNYVSWYQQLPRTAPRLLIYDNNKRPSGIPDRFSASKSGTSATLGITGLQTGDEADYYCGTWDSSLSAVVFGGGTKLTVLG

SEQ ID NO: 5232 - protein, 108 aa, Artificial Sequence
  Description of Artificial Sequence: Synthetic light chain variable domain
DIQMTQSPSSLSASVGDRVTITCQASQDISNYLNWYQQKPGKAPKLLIYDASNLETGVPSRFSGSGSGTDFTFTISSLQPDDFATYYCQQYKSYPLTFGGGTKVEIKR

SEQ ID NO: 5233 - protein, 112 aa, Artificial Sequence
  Description of Artificial Sequence: Synthetic light chain variable domain
QSVVTQPPSVSGAPGQRVTISCTGSSSNIGAGYDVHWYQQLPGTAPKLLIYGNINRPSGVPDRFSGSKSGTSASLAITGLQAEDEADYYCQSYDSNLSGYVFATGTKVTVLG

SEQ ID NO: 5234 - protein, 112 aa, Artificial Sequence
  Description of Artificial Sequence: Synthetic light chain variable domain
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLG

SEQ ID NO: 5235 - protein, 108 aa, Artificial Sequence
  Description of Artificial Sequence: Synthetic light chain variable domain
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPRTFGGGTKLEIKR

SEQ ID NO: 5236 - protein, 213 aa, Artificial Sequence
  Description of Artificial Sequence: Synthetic light chain variable domain
QIVLSQSPIILSASPGEKVTMTCRASSSVSYIHWFQQRTNGSPRPWIYATSNLASGVPVRFSGSGSGTSYSLTISRVEAEDIADYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5237 - protein, 213 aa, Artificial Sequence
  Description of Artificial Sequence: Synthetic light chain variable domain
QIVLSQSPIILSASPGEKVTMTCRASSSVSYIHWFQQRTNGSPRPWIYATSNLASGVPVRFSGSGSGTSYSLTISRVEAEDEADYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5238 - protein, 107 aa, Artificial Sequence
  Description of Artificial Sequence: Synthetic light chain variable domain
DIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIK

SEQ ID NO: 5239 - protein, 107 aa, Artificial Sequence
  Description of Artificial Sequence: Synthetic light chain variable domain
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMK

SEQ ID NO: 5240 - protein, 106 aa, Artificial Sequence
  Description of Artificial Sequence: Synthetic light chain variable domain
EIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQ

SEQ ID NO: 5241 - protein, 107 aa, Artificial Sequence
  Description of Artificial Sequence: Synthetic light chain variable domain
DIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIK

SEQ ID NO: 5242 - protein, 107 aa, Artificial Sequence
  Description of Artificial Sequence: Synthetic light chain variable domain
DIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIK

SEQ ID NO: 5243 - protein, 107 aa, Artificial Sequence
  Description of Artificial Sequence: Synthetic light chain variable domain
MEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELK

SEQ ID NO: 5244 - protein, 108 aa, Artificial Sequence
  Description of Artificial Sequence: Synthetic light chain variable domain
MEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELK

SEQ ID NO: 5245 - protein, 106 aa, Artificial Sequence
  Description of Artificial Sequence: Synthetic light chain variable domain
  MOD_RES (5)..(5): Any amino acid
  MOD_RES (24)..(24): Any amino acid
  MOD_RES (39)..(39): Any amino acid
  MOD_RES (55)..(55): Any amino acid
  MOD_RES (79)..(79): Any amino acid
  MOD_RES (84)..(84): Any amino acid
EIVLXQSPATLSLSPGERATLSCXASSNVSYIHWYQQKXGQAPRPWIYEISKLAXGIPARFSGSGSGTDYTLTISSLEXEDFAXYYCQQWNYPLITFGQGTKLEIK

SEQ ID NO: 5246 - protein, 107 aa, Artificial Sequence
  Description of Artificial Sequence: Synthetic light chain variable domain
  MOD_RES (3)..(3): Any amino acid
  MOD_RES (55)..(55): Any amino acid
  MOD_RES (80)..(80): Any amino acid
DIXMTQSPSSLSASVGDRVTITCRASQDINSYLSWFQQKPGKAPKTLIYRANRLXSGVPSRFSGSGSGQDYTLTISSLQXEDFATYYCLQYDEFPYTFGQGTKLEIK

SEQ ID NO: 5247 - protein, 107 aa, Artificial Sequence
  Description of Artificial Sequence: Synthetic light chain variable domain
DIKMTQSPSSMYASLGERVTITCKASPDINSYLSWFQQKPGKSPKTLIYRANRLVDGVPSRFSGGGSGQDYSLTLNSLEYEDMGIYYCLQYDEFPYTFGGGTKLEMK

SEQ ID NO: 5248 - protein, 108 aa, Artificial Sequence
  Description of Artificial Sequence: Synthetic light chain variable domain
DIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIK

SEQ ID NO: 5249 - protein, 107 aa, Artificial Sequence; identical to SEQ ID NO: 5242
  Description of Artificial Sequence: Synthetic light chain variable domain

SEQ ID NO: 5250 - protein, 107 aa, Artificial Sequence; identical to SEQ ID NO: 5238
  Description of Artificial Sequence: Synthetic light chain variable domain

SEQ ID NO: 5251 - protein, 107 aa, Artificial Sequence; identical to SEQ ID NO: 5239
  Description of Artificial Sequence: Synthetic light chain variable domain

SEQ ID NO: 5252 - protein, 106 aa, Artificial Sequence; identical to SEQ ID NO: 5240
  Description of Artificial Sequence: Synthetic light chain variable domain

SEQ ID NO: 5253 - protein, 107 aa, Artificial Sequence
  Description of Artificial Sequence: Synthetic light chain variable domain
DIVMTQTPLSLPVTPGEPASISCRASKSISKYLAWYQQKPGQAPRLLIYSGSTLQSGIPPRFSGSGYGTDFTLTINNIESEDAAYYFCQQHDESPYTFGEGTKVEIK

SEQ ID NO: 5254 - protein, 107 aa, Artificial Sequence
  Description of Artificial Sequence: Synthetic light chain variable domain
DVVMTQSPLSLPVTLGQPASISCRASKSISKYLAWYQQKPGKAPKLLIYSGSTLQSGIPPRFSGSGYGTDFTLTINNIESEDAAYYFCQQHDESPYTFGEGTKVEIK

SEQ ID NO: 5255 - protein, 112 aa, Artificial Sequence
  Description of Artificial Sequence: Synthetic light chain variable domain
  MOD_RES (86)..(86): Any amino acid
  MOD_RES (89)..(89): Any amino acid
  MOD_RES (92)..(92): Any amino acid
SYELTQPPSVSVSPGQTASITCSGDKLGDKYACWYQQKPGQSPVLVIYQDSKRPSGIPERFSGSNSGNTATLTISGTQAMDEADYXAAXAAXAAAWDSSTVVFGGGTKLTVL

SEQ ID NO: 5256 - protein, 110 aa, Artificial Sequence
  Description of Artificial Sequence: Synthetic light chain variable domain
  MOD_RES (86)..(86): Any amino acid
  MOD_RES (89)..(89): Any amino acid
SYELTQPPSVSVSPGQTASITCSGDKLGDKYACWYQQKPGQSPVLVIYQDSKRPSGIPERFSGSNSGNTATLTISGTQAMDEADYXAAXAAQAWDSSTVVFGGGTKLTVL

SEQ ID NO: 5257 - protein, 120 aa, Artificial Sequence
  Description of Artificial Sequence: Synthetic light chain variable domain
  MOD_RES (65)..(65): Any amino acid
  MOD_RES (87)..(87): Any amino acid
  MOD_RES (96)..(96): Any amino acid
  MOD_RES (99)..(99): Any amino acid
  MOD_RES (102)..(102): Any amino acid
  MOD_RES (105)..(105): Any amino acid
QSVLTQPPSVSVAPGQTARITCGGNNIGTKSVHWYQQKPGQAPVLVLYDESDRPSGIPERFSGSXAASGNTATLTISRVEAGDEADXAALLSGVGXAAXAAXAAXAASLCFGSGTKLTVL

SEQ ID NO: 5258 - protein, 112 aa, Artificial Sequence
  Description of Artificial Sequence: Synthetic light chain variable domain
  MOD_RES (65)..(65): Any amino acid
  MOD_RES (87)..(87): Any amino acid
QSVLTQPPSVSVAPGQTARITCGGNNIGTKSVHWYQQKPGQAPVLVLYDESDRPSGIPERFSGSXAASGNTATLTISRVEAGDEADXAALLQVWDSSSDHYVFGSGTKLTVL

SEQ ID NO: 5259 - protein, 88 aa, Artificial Sequence
  Description of Artificial Sequence: Synthetic light chain variable domain
EIVMTQSPSFLSASVGDRVTITCRASQGISSYLAWYQQKPGKAPKLLIYAASTLQSGSHQGFSGSGSGTEFTLTISSLQPEDFATYYC

SEQ ID NO: 5260 - protein, 106 aa, Artificial Sequence
  Description of Artificial Sequence: Synthetic light chain variable domain
VLTQPPSVSVAPGKTARITCGGNNLGSKNVHWYQQKPGQAPVLVIYDDDNRPSGIPERFSGSNSGNTATLTISRVEAGDEADYYCQVWDSSSRHVVFGGGTKLTVL

SEQ ID NO: 5261 - protein, 110 aa, Artificial Sequence
  Description of Artificial Sequence: Synthetic light chain variable domain
QPVLTQPHSVSESPGKTVTISCTRSSGNIASNFVQWYQRRPDGATTNVIYEDTQRPSGVSGRFSGSIDRSSNSASLTISGLRAEDEADYYCQSYDGRNLMFGGGTKVTVL

SEQ ID NO: 5262 - protein, 110 aa, Artificial Sequence
  Description of Artificial Sequence: Synthetic light chain variable domain
QPVLTQPHSVSESPGKTVTISCTRSSGSIASNYVQWYQQRPGSAPTTVIYEDNQRPSGVPDRFSGSIDSSSNSASLTISGLKTEDEADYYCQSYDSSNHVFGTGTKLTVL

SEQ ID NO: 5263 - protein, 107 aa, Artificial Sequence
  Description of Artificial Sequence: Synthetic light chain variable domain
NIQMTQSPSSLSASVGDRVTITCRASQSINKWLAWYQQKPGKAPKLLIHDASTLESGVPSRFSGSGSGTEFTLTISSLHPDDSATYYCQQLKSPPAQFGEGTKLEIK

SEQ ID NO: 5264 - protein, 107 aa, Artificial Sequence
  Description of Artificial Sequence: Synthetic light chain variable domain
NIQMTQSPSSLSASVGDRVTITCRASQSINKWLAWYQQKPGKAPKLLIHDASTLESGVPSRFSGSGSGTEFTLTISSLHPDDSATYYCQQLKSRPLSFGEGTKLEIK

SEQ ID NO: 5265 - protein, 110 aa, Artificial Sequence
  Description of Artificial Sequence: Synthetic light chain variable domain
QSVLTQPSSVSGTPGQRVTISCSGSSSNIGSNYVYWYQQLPGTAPKLLIYRNNQRPSGVPDRFSGSKSGTSASLGHQWAPGPRMRLIITAAWDDSLSGVVFGGGTKLTVL

SEQ ID NO: 5266 - protein, 108 aa, Artificial Sequence
  Description of Artificial Sequence: Synthetic light chain variable domain
QSVLTQPPSVSVAPGQTARITCGGNNIGSTSVHWFQQKPGQAPVLVVYDDSDRPSGIPERFSGSNSGNTATLTISRVEAGDEADYYCQVWDNDSDHRVFGGGTKLTVL

SEQ ID NO: 5267 - protein, 110 aa, Artificial Sequence
  Description of Artificial Sequence: Synthetic light chain variable domain
QSVLTQPPSVPGTPGQRVTITCSGSRFNIGSNTVNWYQQLPGTAPKLLIYSNNQRPSGVPDRFSGSKSGTSASLAISGLQSEDEADYYCAAWDDSLNGYVFGTGTKLTVL

SEQ ID NO: 5268 - protein, 109 aa, Artificial Sequence
  Description of Artificial Sequence: Synthetic light chain variable domain
  MOD_RES (69)..(69): Any amino acid
QSVLTQPPSVSVAPGQTARITCGGNRIGTKAVHWYQQKSGQAPVLVVRDDTDRPSGSLRDSLAPTLGTXAAATLTISGVEAGDEADYYQVWDSSSDHRVFGGGTKLTVL

SEQ ID NO: 5269 - protein, 111 aa, Artificial Sequence
  Description of Artificial Sequence: Synthetic light chain variable domain
ELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVT

SEQ ID NO: 5270 - protein, 111 aa, Artificial Sequence
  Description of Artificial Sequence: Synthetic light chain variable domain
QSALTQPPSASGTPGQRVTISCPGSSSNIGSNYVYWYQQLPGTAPKLLIYRNNQRPSGVPDRFSGSKSGTSATLGITGLQTGDEADYYCGTWDSSLSAYVFGTGTKVTVLG

SEQ ID NO: 5271 - protein, 112 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSIPWVFGGGTKLTVLG

SEQ ID NO: 5272 - protein, 111 aa, Artificial Sequence
  Description of Artificial Sequence: Synthetic light chain variable domain
QSALTQPASVSGSPGQSITISCTGTSRDVGGYDYVSWYQQYPGNAPKLMIYDVSRRPSGVSHRFSASKSGNTASLTISGLQTEDEADYYCSSYTSSSTRVFGGGTKVTVLG

SEQ ID NO: 5273 - protein, 112 aa, Artificial Sequence
  Description of Artificial Sequence: Synthetic light chain variable domain
QSALTQPASVSGSPGQSITISCTGTSSDVGGYNYVSWYQQHPGKAPKLMIYDVSKRPSGVSNRFSGSKSGNTASLTISGLQAEDEADYYCSSYTSSSTSVVFGGGTKLTVLG

SEQ ID NO: 5274 - protein, 111 aa, Artificial Sequence
  Description of Artificial Sequence: Synthetic light chain variable domain
QSVLTQPASVSGSPGQSITISCTGTTSDVGGYNYVSWYQQHPGKAPKLMIYDVSKRPSGVSNRFSGSKSGNTASLTISGLQAEDEADYYCSSYTSSSTDVFGTGTKLTVLG

SEQ ID NO: 5275 - protein, 108 aa, Artificial Sequence
  Description of Artificial Sequence: Synthetic light chain variable domain
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIKR

SEQ ID NO: 5276 - protein, 111 aa, Artificial Sequence
  Description of Artificial Sequence: Synthetic light chain variable domain
QSALTQPASVSASPGQSITISCTGTSSDVGGYNYVTWYQQHPGKAPKLMIYDVSKRPSGVLDRFSGSKSGNTASLTISGLQAEDEADYFCSSYTSSSTLVFGGGTKLTVLG

SEQ ID NO: 5277 - protein, 111 aa, Artificial Sequence
  Description of Artificial Sequence: Synthetic light chain variable domain
QSALTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKVTVLG

SEQ ID NO: 5278 - protein, 111 aa, Artificial Sequence
  Description of Artificial Sequence: Synthetic light chain variable domain
QSVLTQPPSASGAPGQRVTISCSGGISNVGTNGVNWYQHLPGTAPKLLVDAMNQRPSGVPDRFSGSRSGTSGSLAITGLRSEDEADYYCATWDDSLSGVLFGGGTKLTVLG

SEQ ID NO: 5279 - protein, 108 aa, Artificial Sequence
  Description of Artificial Sequence: Synthetic light chain variable domain
DIQMTQSPSSLSASVGDRVTITCQASQDIRNYLNWYQQKPGKAPKLLIYAASNLETGVPSRFSGSGSGTDFTFTISSLQPEDIATYYCQQDDNLPLTFGGGTKLEIKR

SEQ ID NO: 5280 - protein, 108 aa, Artificial Sequence
  Description of Artificial Sequence: Synthetic light chain variable domain
DIVMTQSPSSLSASVGDRVTITCQASQDISNYLNWYQQKPGKAPKLLIYDASNLETGVPSRFSGSGSGTDFIFTISSLQPEDIATYYCQQFDNLPYTFGQGTKVEIKR

SEQ ID NO: 5281 - protein, 106 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSLFGQGTKVEIKR

SEQ ID NO: 5282 - protein, 106 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFGPGTKVDIKR

SEQ ID NO: 5283 - protein, 108 aa, Artificial Sequence
  Description of Artificial Sequence: Synthetic light chain variable domain
DIQLTQSPSSLSASVGDRVTITCRASQNINNYLNWYQQKPGKAPKLLLYAASSLQSGVPSRFSGSGSGTEFTLTISSLHPEDFATYYCQQSYNTPFTFGPGTKVDIKR

SEQ ID NO: 5284 - protein, 109 aa, Artificial Sequence
  Description of Artificial Sequence: Synthetic light chain variable domain
DIQLTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIKR

SEQ ID NO: 5285 - protein, 111 aa, Artificial Sequence
  Description of Artificial Sequence: Synthetic light chain variable domain
QSALTQPASVSGSPGQSITISCTGTSSDFGDYDYVSWYQQHPGKAPKLMIYDVSDRPSGVSNRFSGSKSGNTASLTISGLQAEDEADYFCSSFTTSSTLVFGGGTKLTVLG

SEQ ID NO: 5286 - protein, 108 aa, Artificial Sequence
  Description of Artificial Sequence: Synthetic light chain variable domain
AIRMTQSPSSLSASVGDRVTITCQASQDISNYLNWYQQKPGKAPKLLIYAASSLQSGVPSRFSGSGSGTDFTLTISSLQPEDFATYYCQQSYSTPFTFGPGTKVDIKR

SEQ ID NO: 5287 - protein, 111 aa, Artificial Sequence
  Description of Artificial Sequence: Synthetic light chain variable domain
QSVLTQPASVSGSPGQSITISCTGTSSDFGDYDYVSWYQQHPGKAPKLMIYDVSDRPSGVSNRFSGSKSGNTASLTISGLQAEDEADYFCSSLTTSSTLVFGGGTKLTVLG

SEQ ID NO: 5288 - protein, 108 aa, Artificial Sequence
  Description of Artificial Sequence: Synthetic light chain variable domain
AIQMTQSPSSLSASVGDRVTITCRTSQSISSYLNWYQQKPGKAPKLLIYAASSLQSGVPSRFSGSGSGTDFTLTISSLQPEDFATYYCQQSYSTPFTFGPGTKVDIKR

SEQ ID NO: 5289 - protein, 111 aa, Artificial Sequence
  Description of Artificial Sequence: Synthetic light chain variable domain
QSVLTQPPSVSGTPGQRVTIFCSGGSNNIGRSSVYWYRQAAGTAPKLLIYKTDQRPSGVPDRFAASKSGASASLAISGLRSEDEADYHCATWDDSLSAVVFGGGTKLTVLG

SEQ ID NO: 5290 - protein, 116 aa, Artificial Sequence
  Description of Artificial Sequence: Synthetic light chain variable domain
QSALTQPALTQPASVSGSPGQSITISCTGTSSDFGDYDYVSWYQQHPGKAPKLMIYDVSDRPSGVSNRFSGSKSGNTASLTISGLQAEDEADYFCSSFTTSSTLVFGGGTKLTVLG

SEQ ID NO: 5291 - protein, 112 aa, Artificial Sequence
  Description of Artificial Sequence: Synthetic light chain variable domain
NFMLTQPRSVSESPGKTVTISCTGNGGRVANNYVQWYQQRPGSAPTTVIYEDNQRPSGVPARFSGSIDSSSNSASLTISGLKTDDEADYYCQSYDISNQRVFGGGTKLTVLG

SEQ ID NO: 5292 - protein, 107 aa, Artificial Sequence
  Description of Artificial Sequence: Synthetic light chain variable domain
DIQMTQSPSSVSASVGDRVTITCRASQGISTLLAWYQQKPGKAPKLLISSASSLQSGVPARFSGSGSGTDFTLTISSLQPEDFATYYCQQSYRAPTFGQGTKVEIKR

SEQ ID NO: 5293 - protein, 108 aa, Artificial Sequence
  Description of Artificial Sequence: Synthetic light chain variable domain
ETTLTQSPAFMSATPGDKVNISCKASQDIDDDLNWYQQKPGEAPILIIQEATTLVPGIPPRFSGSGFGTDFTLTINSMQSEDVAYYFCLQHDNFPPTFGQGTKVEIKR

SEQ ID NO: 5294 - protein, 108 aa, Artificial Sequence
  Description of Artificial Sequence: Synthetic light chain variable domain
DIQLAQSPSSLSASVGDRVTITCRASQSISNYLNWYQQKPGKAPKLLIYAASSLQSGVPSRFSGSGSGTDFTLTISSLQPEDFATYYCQQSYSTPFTFGPGTKVEIKR

SEQ ID NO: 5295 - protein, 111 aa, Artificial Sequence
  Description of Artificial Sequence: Synthetic light chain variable domain
QSVVTQPPSVSAAPGQKVTISCSGSSSNIGKNYVSWYQQFPGTAPKLLIYDNNERPSGIPARFSGSKSGTSATLGITGLQTGDEADYYCATFDTSLWAAVFGGGTKLTVLG

SEQ ID NO: 5296 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLLIYEVSQRPSGVPDRFSGSKSGNTASLTVSGLQAEDEADYYCSSYAGDRDVFGTGTQLTVLS

SEQ ID NO: 5297 - protein, 108 aa, Artificial Sequence
  Description of Artificial Sequence: Synthetic light chain variable domain
DIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKR

SEQ ID NO: 5298 - protein, 111 aa, Artificial Sequence
  Description of Artificial Sequence: Synthetic light chain variable domain
QSALTQPASVSGSPGQSITLSCTGTSSDVGGYNYVSWYQQHPGNGPKLIIYDVTKRPSGVSNRFSGSKSGNTAYLTISGLQAEDEADYYCASYTRSTTLVFGGGTKLTVLG

SEQ ID NO: 5299 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLMIYDVSKRPSGVSNRFSGSKSGNTASLTISGLQAEDEADYYCSSYTGRSTVFGGGTKLTVLG

SEQ ID NO: 5300 - protein, 111 aa, Artificial Sequence
  Description of Artificial Sequence: Synthetic light chain variable domain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGGGTKLTVLG

SEQ ID NO: 5301 - protein, 112 aa, Artificial Sequence
  Description of Artificial Sequence: Synthetic light chain variable domain
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKLTVLG

SEQ ID NO: 5302 - protein, 110 aa, Artificial Sequence
  Description of Artificial Sequence: Synthetic light chain variable domain
CSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVFGGGTKLTVLG

SEQ ID NO: 5303 - protein, 111 aa, Artificial Sequence
  Description of Artificial Sequence: Synthetic light chain variable domain
QSVLTQPPSASGTPGQRVTISCSGSSSNIGSNTVNWYQQLPGTAPKLLIYSNNQRPSGVPDRFSGSKSGTSASLAIRGLQSDDEAEYYCAAWDDSLKSFVFGKGTKVTVLG

SEQ ID NO: 5304 - protein, 111 aa, Artificial Sequence
  Description of Artificial Sequence: Synthetic light chain variable domain
QSALTQPPSASGTPGQRVTISCSGSSSNIGSNYVYWYQQLPGTAPKLLIYRNNQRPSGVPDRFSGSKSGTSASLAISGLRSEDEADYYCAAWDDSLSAWVFGGGTKLTVLG

SEQ ID NO: 5305 - protein, 108 aa, Artificial Sequence
  Description of Artificial Sequence: Synthetic light chain variable domain
AIQMTQSPSSLSASVGDRVTITCRASQSISSHLNWYQQKPGKAPKLLIYAASSLQSGVPSRFSGSGSGTDFTLTISSLQPEDFATYYCQQSYSTPFTFGPGTKVDIKR

SEQ ID NO: 5306 - protein, 108 aa, Artificial Sequence
  Description of Artificial Sequence: Synthetic light chain variable domain
DIQLTQSPSSLSASVGDRVTITCQASQDVRNYLNWYQQKPGKAPNLLIYDATNLESGVPSRFSGSGSGTDFTFTISSLQPEDFATYYCQQYDNLPLSFGGGTKVEIKR

SEQ ID NO: 5307 - protein, 109 aa, Artificial Sequence
  Description of Artificial Sequence: Synthetic light chain variable domain
EIVLTQSPDTLSLSPGERATLSCRASQSVSSNLAWYQQKPGQAPRLLIYGASTRATGIPARFSGSGSGTEFTLTISSLQSEDFAVYYCQQYNNWPPYTFGQGTKVEIKR

SEQ ID NO: 5308 - protein, 109 aa, Artificial Sequence
  Description of Artificial Sequence: Synthetic light chain variable domain
EIVMTQSPATLSVSPGERATLSCRASQSVSSNLAWYQQKPGQAPRLLIYGASTRATGIPARFSGSGSGTEFTLTISSLQSEDFAVYYCQQYNNWPPYTFGQGTKVEIKR

SEQ ID NO: 5309 - protein, 108 aa, Artificial Sequence
  Description of Artificial Sequence: Synthetic light chain variable domain
AIRMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIKR

SEQ ID NO: 5310 - protein, 109 aa, Artificial Sequence
  Description of Artificial Sequence: Synthetic light chain variable domain
QSVLTQPPSVSVAPGETARITCGGTNIGSESVHWYQQRPGQAPVLVVYDDTDRPSGIPERFSGSNSGNTATLTISRVEAGDGADYYCQVWDSVSDRYVFGTGTKVTVLG

SEQ ID NO: 5311 - protein, 112 aa, Artificial Sequence
  Description of Artificial Sequence: Synthetic light chain variable domain
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLWVFGGGTKLTVLG

SEQ ID NO: 5312 - protein, 111 aa, Artificial Sequence
  Description of Artificial Sequence: Synthetic light chain variable domain
QSALTQPASVSGSPGQSITISCTGTSSDVGGYNYVSWYQQHPGKAPKFMIYDVSKRPSGVSNRFSGSKSGNTASLTISGLQAEDEADYYCGSFTSSITYVFGTGTKVTVLG

SEQ ID NO: 5313 - protein, 110 aa, Artificial Sequence
  Description of Artificial Sequence: Synthetic light chain variable domain
QSALTQPASVSGSPGQSITISCTGTSSDVGGYNYVSWYQQHPGKAPKLMIFDVSNRPSGVSNRFSGSKSGNTASLTISGLQAEDEADYYCSSYTSSSTLFGGGTKLTVLG

SEQ ID NO: 5314 - protein, 111 aa, Artificial Sequence
  Description of Artificial Sequence: Synthetic light chain variable domain
DIVMTQSPDSLAVSLGERATINCKASQSVDYDGDSYMNWYQQKPGQPPKLLIYAASNLESGVPDRFSGSGSGTDFTLTISSLQAEDVAVYYCQQSNEDPYTFGQGTKLEIK

SEQ ID NO: 5315 - protein, 111 aa, Artificial Sequence
  Description of Artificial Sequence: Synthetic light chain variable domain
DIVMTQSPASLAVSLGQRATISCKASQSVDYDGDSYMNWYQQKPGQPPKLLIYAASNLESGIPARFSGSGSGTDFTLNIHPVEEEDAATYYCQQSNEDPYTFGGGTKLEIK

SEQ ID NO: 5316 - protein, 107 aa, Artificial Sequence
  Description of Artificial Sequence: Synthetic light chain variable domain
DIQMTQSPSSLSASLGDTITITCHASQNINVWLSWYQQKPGNIPKLLIYKASNLHTGVPSRFSGSGSGTGFTLTISSLQPEDIATYYCQQGQSYPYTFGGGTKLEIK

SEQ ID NO: 5317 - protein, 220 aa, Artificial Sequence
  Description of Artificial Sequence: Synthetic light chain variable domain
DIQMTQSPILLSASVGDRVTITCKSSQSLLYSGNQKNYLAWYQQRTNGSPRLLIYWASARESGVPSRFSGSRSGTDFTLTISSLQPEDEADYYCQQYYSYPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5318 - protein, 106 aa, Artificial Sequence
  Description of Artificial Sequence: Synthetic light chain variable domain
EIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIK

SEQ ID NO: 5319 - protein, 107 aa, Artificial Sequence [sequence omitted]

SEQ ID NO: 5320 - protein, 108 aa, Artificial Sequence
  Description of Artificial Sequence: Synthetic light chain variable domain
DIQMTQSPSSLSASVGDRVTIACRASQTISRYLNWYQQKPGKAPKLLIYAASSLQSGVSSRFSGSGSGTEFTLTISSLQPEDFATYFCQQTYSPPITFGQGTRLEIKR

SEQ ID NO: 5321 - protein, 108 aa, Artificial Sequence
  Description of Artificial Sequence: Synthetic light chain variable domain
DIQLTQSPSSLSASVGDRVTITCRASRAISRYLNWYQQKPGKAPKLLIYAASSLQSGVSSRFSGSGSGTEFTLTISSLQPEDFATYFCQQTYSPPITFGQGTRLEIKR

SEQ ID NO: 5322 - protein, 450 aa, Artificial Sequence
  Description of Artificial Sequence: Synthetic light chain variable domain
EVQLLESGGGLVQPGGSLRLSCAASGFTFSMYGMVWVRQAPGKGLEWVSVISPSGGNTGYADSVKGRFTISRDNSKNTLYLQMNSLRAEDTAVYYCARAPRGYSYGYYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5323 - protein, 107 aa, Artificial Sequence
  Description of Artificial Sequence: Synthetic light chain variable domain
DIQMTQSPSSLSASVGDRVTITCRASEHIYSYLSWYQQKPGKAPKLLIYNAKTLAEGVPSRFSGSGSGTDFTLTISSLQPEDFATYYCQHHFGSPLTFGQGTRLEIK

SEQ ID NO: 5324 - protein, 107 aa, Artificial Sequence
  Description of Artificial Sequence: Synthetic light chain variable domain
DIQMTQSPSSLSASVGDRVTITCRASEHIYSYLSWYQQKPGKAPKLLIYNAKTLAEGVPSRFSGSGSGTQFTLTISSLQPEDFATYYCQHHFGSPLTFGQGTRLEIK

SEQ ID NO: 5325 - protein, 107 aa, Artificial Sequence
  Description of Artificial Sequence: Synthetic light chain variable domain
DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK

SEQ ID NO: 5326 - protein, 107 aa, Artificial Sequence
  Description of Artificial Sequence: Synthetic light chain variable domain
DIQMTQSPSSLSASVGDRVTITCRASEHIYSYLSWYQQKPGKVPKLLIYNAKTLAEGVPSRFSGSGSGTQFTLTISSLQPEDVATYYCQHHFGSPLTFGQGTRLEIK

SEQ ID NO: 5327 - protein, 106 aa, Artificial Sequence
  Description of Artificial Sequence: Synthetic light chain variable domain
DIQMTQSPSLLSASVGDRVTLNCIASQNIYKSLAWYQLKLGEAPKLLIYNANSLQAGIPSRFSGSGSGTDFALTISGLQPEDVATYFCQQYSGGYTFGAGTKLELK

SEQ ID NO: 5328 - protein, 106 aa, Artificial Sequence
  Description of Artificial Sequence: Synthetic light chain variable domain
NIVMAQSPKSMSISAGDRVTMNCKASQNVDNNIAWYQQKPGQSPKLLIFYASNRYSGVPDRFTGGGYGTDFTLTIKSVQAEDAAFYYCQRIYNFPTFGSGTKLEIK

SEQ ID NO: 5329 - protein, 106 aa, Artificial Sequence
  Description of Artificial Sequence: Synthetic light chain variable domain
  MOD_RES (10)..(10): Any amino acid
  MOD_RES (21)..(22): Any amino acid
  MOD_RES (40)..(40): Any amino acid
  MOD_RES (42)..(43): Any amino acid
  MOD_RES (46)..(46): Any amino acid
  MOD_RES (52)..(53): Any amino acid
  MOD_RES (58)..(58): Any amino acid
  MOD_RES (77)..(77): Any amino acid
  MOD_RES (83)..(83): Any amino acid
  MOD_RES (87)..(87): Any amino acid
  MOD_RES (95)..(95): Any amino acid
  MOD_RES (105)..(105): Any amino acid
DIQMTQSPSXLSASVGDRVTXXCKASQSIHKNLAWYQQKXGXXPKXLIYYAXXLQTGXPSRFSGSGSGTDFTLTISXLQPEDXATYXCQQYYSGXTFGGGTKVEXK

SEQ ID NO: 5330 - protein, 106 aa, Artificial Sequence
  Description of Artificial Sequence: Synthetic light chain variable domain
  MOD_RES (43)..(43): Any amino acid
  MOD_RES (46)..(46): Any amino acid
  MOD_RES (52)..(53): Any amino acid
  MOD_RES (58)..(58): Any amino acid
  MOD_RES (83)..(83): Any amino acid
  MOD_RES (95)..(95): Any amino acid
DIQMTQSPSSLSASVGDRVTITCKASQSIHKNLAWYQQKPGKXPKXLIYYAXXLQTGXPSRFSGSGSGTDFTLTISSLQPEDXATYYCQQYYSGXTFGGGTKVEIK

SEQ ID NO: 5331 - protein, 107 aa, Artificial Sequence
  Description of Artificial Sequence: Synthetic light chain variable domain
  MOD_RES (9)..(9): Any amino acid
  MOD_RES (17)..(18): Any amino acid
  MOD_RES (40)..(40): Any amino acid
  MOD_RES (43)..(43): Any amino acid
  MOD_RES (45)..(45): Any amino acid
  MOD_RES (48)..(48): Any amino acid
  MOD_RES (50)..(51): Any amino acid
  MOD_RES (70)..(70): Any amino acid
  MOD_RES (72)..(72): Any amino acid
  MOD_RES (74)..(74): Any amino acid
  MOD_RES (76)..(76): Any amino acid
  MOD_RES (83)..(84): Any amino acid
  MOD_RES (100)..(100): Any amino acid
  MOD_RES (103)..(103): Any amino acid
  MOD_RES (106)..(106): Any amino acid
DIQMTQSPXSLSASVGXXVTITCRASEHIYSYLSWYQQKXGKXPXLLXYXXKTLAEGVPSRFSGSGSGTXFXLXIXSLQPEDXXTYYCQHHFGSPLTFGXGTXLEXK

SEQ ID NO: 5332 - protein, 107 aa, Artificial Sequence
  Description of Artificial Sequence: Synthetic light chain variable domain
  MOD_RES (43)..(43): Any amino acid
  MOD_RES (50)..(51): Any amino acid
  MOD_RES (70)..(70): Any amino acid
  MOD_RES (83)..(83): Any amino acid
DIQMTQSPSSLSASVGDRVTITCRASEHIYSYLSWYQQKPGKXPKLLIYXXKTLAEGVPSRFSGSGSGTXFTLTISSLQPEDXATYYCQHHFGSPLTFGQGTRLEIK

SEQ ID NO: 5333 - protein, 106 aa, Artificial Sequence
  Description of Artificial Sequence: Synthetic light chain variable domain
DIQMTQSPSSLSASVGDRVTITCKASQSIHKNLAWYQQKPGKAPKLLIYYANSLQTGVPSRFSGSGSGTDFTLTISSLQPEDFATYYCQQYYSGWTFGGGTKVEIK

SEQ ID NO: 5334 - protein, 106 aa, Artificial Sequence
  Description of Artificial Sequence: Synthetic light chain variable domain
DIQMTQSPSSLSASVGDRVTITCKASQSIHKNLAWYQQKPGKAPKFLIYYANSLQTGVPSRFSGSGSGTDFTLTISSLQPEDFATYYCQQYYSGWTFGGGTKVEIK

SEQ ID NO: 5335 - protein, 106 aa, Artificial Sequence
  Description of Artificial Sequence: Synthetic light chain variable domain
DIQMTQSPSSLSASVGDRVTITCKASQSIHKNLAWYQQKPGKAPKFLIYYANSLQTGIPSRFSGSGSGTDFTLTISSLQPEDFATYYCQQYYSGWTFGGGTKVEIK

SEQ ID NO: 5336 - protein, 106 aa, Artificial Sequence
  Description of Artificial Sequence: Synthetic light chain variable domain
DIQMTQSPSSLSASVGDRVTITCKASQSIHKNLAWYQQKPGKVPKLLIYYANSLQTGVPSRFSGSGSGTDFTLTISSLQPEDVATYYCQQYYSGWTFGGGTKVEIK

SEQ ID NO: 5337 - protein, 106 aa, Artificial Sequence
  Description of Artificial Sequence: Synthetic light chain variable domain
DIQMTQSPSSLSASVGDRVTITCKASQSIHKNLAWYQQKPGKVPKFLIYYANSLQTGVPSRFSGSGSGTDFTLTISSLQPEDVATYYCQQYYSGWTFGGGTKVEIK

SEQ ID NO: 5338 - protein, 106 aa, Artificial Sequence
  Description of Artificial Sequence: Synthetic light chain variable domain
DIQMTQSPSSLSASVGDRVTITCKASQSIHKNLAWYQQKPGKVPKFLIYYANSLQTGIPSRFSGSGSGTDFTLTISSLQPEDVATYYCQQYYSGWTFGGGTKVEIK

SEQ ID NO: 5339 - protein, 106 aa, Artificial Sequence
  Description of Artificial Sequence: Synthetic light chain variable domain
DIQMTQSPSSLSASVGDRVTITCKASQSIHKNLAWYQQKPGKAPKLLIYYANSLQTGVPSRFSGSGSGTDFTLTISSLQPEDFATYFCQQYYSGWTFGGGTKVEIK

SEQ ID NO: 5340 - protein, 106 aa, Artificial Sequence
  Description of Artificial Sequence: Synthetic light chain variable domain
DIQMTQSPSSLSASVGDRVTITCKASQSIHKNLAWYQQKPGKAPKFLIYYANSLQTGVPSRFSGSGSGTDFTLTISSLQPEDFATYFCQQYYSGWTFGGGTKVEIK

SEQ ID NO: 5341 - protein, 106 aa, Artificial Sequence
  Description of Artificial Sequence: Synthetic light chain variable domain
DIQMTQSPSSLSASVGDRVTITCKASQSIHKNLAWYQQKPGKAPKLLIYYANSLQTGIPSRFSGSGSGTDFTLTISSLQPEDFATYYCQQYYSGWTFGGGTKVEIK

SEQ ID NO: 5342 - protein, 107 aa, Artificial Sequence
  Description of Artificial Sequence: Synthetic light chain variable domain
DIVMTQSHKFMSTSVGDRVSITCKASQGVSTTVAWYQQKPGQSPKLLIYSASYRYTGVPDRFTGSGSGTDFTFTISSVQSEDLAVYYCQHYYSTPWTFGGGTKLEIK

SEQ ID NO: 5343 - protein, 107 aa, Artificial Sequence
  Description of Artificial Sequence: Synthetic light chain variable domain
DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELK

SEQ ID NO: 5344 - protein, 106 aa, Artificial Sequence
  Description of Artificial Sequence: Synthetic light chain variable domain
DIQMTQSPSLLSASVGDRVTLNCKASQSIHKNLAWYQQKLGEAPKFLIYYANSLQTGIPSRFSGSGSGTDFTLTISGLQPEDVATYFCQQYYSGWTFGGGTKVELK

SEQ ID NO: 5345 - protein, 111 aa, Artificial Sequence
  Description of Artificial Sequence: Synthetic light chain variable domain
DIVLTQSPASLAVSLGQRATISCRASESVDSYGKSFMHWYQQKPGQPPKLLIYRASNLESGIPARFSGSGSRTDFTLTINPVEADDVATYYCQQSNEDPTFGGGTKLEIKR

SEQ ID NO: 5346 - protein, 108 aa, Artificial Sequence
  Description of Artificial Sequence: Synthetic light chain variable domain
DIVMTQSQKFMSTSVGDRVSVNCKASQNVGTNVVWYQQKPGQSPKALIYSASYRYSGVPDRFTGSGSGTDFTLTISTVQSEDLAEYFCQQYNSYPLTFGGGTKLEIKR

SEQ ID NO: 5347 - protein, 109 aa, Artificial Sequence
  Description of Artificial Sequence: Synthetic light chain variable domain
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVL

SEQ ID NO: 5348 - protein, 97 aa, Artificial Sequence
  Description of Artificial Sequence: Synthetic light chain variable domain
EKVTMSCKSSQSLLYSSNQKNYLAWYQQKPGQSPKLLIYWASARESGVPDRFTGGGSGTDFTLTISSVQAEDLAVYYCHQYLSSYTFGGGTKLEIKR

SEQ ID NO: 5349 - protein, 109 aa, Artificial Sequence
  Description of Artificial Sequence: Synthetic light chain variable domain
QIVLTQSPAIMSASPGEKVTLTCSASSSVSSSYLYWYQQKPGSSPKLWIYSTSNLASGVPARFSGGGSGTSYSLTISSMEAEDAASYFCHQWSTYPYTFGGGTKLEIKR

SEQ ID NO: 5350 - protein, 107 aa, Artificial Sequence
  Description of Artificial Sequence: Synthetic light chain variable domain
DIVMTQSHKFMSTSVGDRVSITCKASQDVNTAVAWYQQKPGHSPKLLIYSASYHYTGVPDRFTGSGSGTDFTFTISSVQAEDLAVYYCQQHYSTPWTFGGGTKLEIK

SEQ ID NO: 5351 - protein, 112 aa, Artificial Sequence
  Description of Artificial Sequence: Synthetic light chain variable domain
NIMMTQSPSSLAVSAGEKVTMSCKSSQSVLYSSNQKNYLAWYQQKPGQSPKLLIYWASTRESGVPDRFTGSGSGTDFTLTINNVQAEDLAVYYCHQYLSSWTFGGGTKLEIK

SEQ ID NO: 5352 - protein, 107 aa, Artificial Sequence
  Description of Artificial Sequence: Synthetic light chain variable domain
DIQMTQSPSSLSASLGERVSLTCRASQEISGYLSWLQQKPDGTIKRLIYAASTLDSGVPKRFSGSRSGSDYSLTISSLESEDFADYYCLQYASYPLTFGAGTKLELK

SEQ ID NO: 5353 - protein, 112 aa, Artificial Sequence
  Description of Artificial Sequence: Synthetic light chain variable domain
NIMMTQSPSSLAVSAGEKVTMSCKSSQSVLYSSNQKNYLAWYQQKPGQSPKLLIYWASTRESGVPDRFTGSGSETDFTLTISSVQTEDLAVYYCHQYLSSWTFGGGTKLEIK

SEQ ID NO: 5354 - protein, 112 aa, Artificial Sequence
  Description of Artificial Sequence: Synthetic light chain variable domain
DIVLTQSPASLAVSLGQRATISCRASESVDSYGKSFMHWYQQKPGQPPKLLIYRASNLESGIPARFSGSGSRTDFTLTINPVEADDVATYYCQQSNEDPYTFGGGTKLEIKR

SEQ ID NO: 5355 - protein, 111 aa, Artificial Sequence
  Description of Artificial Sequence: Synthetic light chain variable domain
DIVLTQSPASLAVSLGQRATISCRASESVDIYGNSFMHWYQQKPGQPPKLLIYRASNLESGIPARFRGSGSRTDFTLTIYPVEADDVATYYCQQSNEDPWTFGGGTKLEIK

SEQ ID NO: 5356 - protein, 103 aa, Artificial Sequence
  Description of Artificial Sequence: Synthetic light chain variable domain
GVVVTQSPTSLAVSLGQRATISCKASQSVDHAGDSYMNWYQQKAGQPPKLLIYGASYLESVIPGRFSGSGSGTDFTLNIHPVEEEDVATYFCQQSNEDPYTFG

SEQ ID NO: 5357 - protein, 108 aa, Artificial Sequence
  Description of Artificial Sequence: Synthetic light chain variable domain
ENVLTQSPAIMSASPGEKVTMTCRASSSVSSNYLHWYQQKSGASPKLWIYSTSNLASGVPDRFRGSGSGTSYSLTITSVEAEDAATYYCQLYSGYPLTFGAGTKLELK

SEQ ID NO: 5358 - protein, 113 aa, Artificial Sequence
  Description of Artificial Sequence: Synthetic light chain variable domain
NIMMTQSPSSLAVSAGEKVTMSCKSSQSLLYSSNQKNYLAWYQQKPGQSPKLLIYWASARESGVPDRFTGGGSGTDFTLTISSVQAEDLAVYYCHQYLSSYTFGGGTKLEIKR

SEQ ID NO: 5359 - protein, 109 aa, Artificial Sequence; identical to SEQ ID NO: 5349
  Description of Artificial Sequence: Synthetic light chain variable domain

SEQ ID NO: 5360 - protein, 107 aa, Artificial Sequence; identical to SEQ ID NO: 5350
  Description of Artificial Sequence: Synthetic light chain variable domain

SEQ ID NO: 5361 - protein, 112 aa, Artificial Sequence; identical to SEQ ID NO: 5351
  Description of Artificial Sequence: Synthetic light chain variable domain

SEQ ID NO: 5362 - protein, 107 aa, Artificial Sequence; identical to SEQ ID NO: 5352
  Description of Artificial Sequence: Synthetic light chain variable domain

SEQ ID NO: 5363 - protein, 112 aa, Artificial Sequence; identical to SEQ ID NO: 5353
  Description of Artificial Sequence: Synthetic light chain variable domain

SEQ ID NO: 5364 - protein, 111 aa, Artificial Sequence; identical to SEQ ID NO: 5355
  Description of Artificial Sequence: Synthetic light chain variable domain

SEQ ID NO: 5365 - protein, 103 aa, Artificial Sequence; identical to SEQ ID NO: 5356
  Description of Artificial Sequence: Synthetic light chain variable domain

SEQ ID NO: 5366 - protein, 108 aa, Artificial Sequence; identical to SEQ ID NO: 5357
  Description of Artificial Sequence: Synthetic light chain variable domain

SEQ ID NO: 5367 - protein, 108 aa, Artificial Sequence; identical to SEQ ID NO: 5346
  Description of Artificial Sequence: Synthetic light chain variable domain

SEQ ID NO: 5368 - protein, 112 aa, Artificial Sequence; identical to SEQ ID NO: 5354
  Description of Artificial Sequence: Synthetic light chain variable domain

SEQ ID NO: 5369 - protein, 109 aa, Artificial Sequence; identical to SEQ ID NO: 5347
  Description of Artificial Sequence: Synthetic light chain variable domain

SEQ ID NO: 5370 - protein, 106 aa, Artificial Sequence
  Description of Artificial Sequence: Synthetic light chain variable domain
QIVLTQSPAIMSASLGEEITLTCSASSSVSYMHWYQQKSGTSPKLLIYSTSNLASGVPSRFSGSGSGTFYSLTISSVEAEDAADYYCHQWSSYPYTFGGGTKLEIK

SEQ ID NO: 5371 - protein, 109 aa, Artificial Sequence
  Description of Artificial Sequence: Synthetic light chain variable domain
NIMMTQSPSSLAVSAGEKVTMSCKSSQSVSNQKNYLAWYQQKPGQSPKLLIYWASTRESGVPDRFTGSGSGTDFTLTISSVQAEDLAVYYCHQYLSSYTFGGGTKLEIK

SEQ ID NO: 5372 - protein, 106 aa, Artificial Sequence
  Description of Artificial Sequence: Synthetic light chain variable domain
DIQLTQSPASLSASVGETVTITCRASGNIHNYLAWYQQKQGKSPQLLVYNAKTLADGVPSRFSGSGSGTQYSLKINSLQPEDFGSYYCQHFWITPWTFGGGTKLEI

SEQ ID NO: 5373 - protein, 110 aa, Artificial Sequence
  Description of Artificial Sequence: Synthetic light chain variable domain
QAVVTQESALTTSPGETVTLTCRSSTGAVTTSNYANWVQEKPDHLFTGLIGGTNNRGPGVPARFSGSLIGDKAALTITGAQTEDEAVYFCALWYSNHWVFGGGTKLTVLG

SEQ ID NO: 5374 - protein, 90 aa, Artificial Sequence
  Description of Artificial Sequence: Synthetic light chain variable domain
EEITLTCSASSSVSYMHWYQQKSGTSPKLLIYSTSNLASGVPSRFSGSGSGTFYSLTISSVEAEDAADYYCHQWSSYPYTFGGGTKLEIK

SEQ ID NO: 5375 - protein, 112 aa, Artificial Sequence
  Description of Artificial Sequence: Synthetic light chain variable domain
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSYTFGGGTKLEIK

SEQ ID NO: 5376 - protein, 112 aa, Artificial Sequence
  Description of Artificial Sequence: Synthetic light chain variable domain
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLGQP

SEQ ID NO: 5377 - protein, 214 aa, Artificial Sequence
  Description of Artificial Sequence: Synthetic light chain variable domain
DIQMTQSPILLSASVGDRVTITCRASRDIKSYLNWYQQRTNGSPRLLIYYATSLAEGVPSRFSGSGSGTDYTLTISSLQPEDIADYYCLQHGESPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5378 - protein, 214 aa, Artificial Sequence
  Description of Artificial Sequence: Synthetic light chain variable domain
DIQMTQSPILLSASVGDRVTITCRASRDIKSYLNWYQQRTNGSPRLLIYYATSLAEGVPSRFSGSGSGTDYTLTISSLQPEDEADYYCLQHGESPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5379 - protein, 113 aa, Artificial Sequence
  Description of Artificial Sequence: Synthetic light chain variable domain
DVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKR

SEQ ID NO: 5380 - protein, 106 aa, Artificial Sequence
  Description of Artificial Sequence: Synthetic light chain variable domain
DIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTGGGTKLEIK

SEQ ID NO: 5381 - protein, 108 aa, Artificial Sequence; identical to SEQ ID NO: 3483
  Description of Artificial Sequence: Synthetic light chain variable domain

SEQ ID NO: 5382 - protein, 107 aa, Artificial Sequence; identical to SEQ ID NO: 3484
  Description of Artificial Sequence: Synthetic light chain variable domain

SEQ ID NO: 5383 - protein, 108 aa, Artificial Sequence; identical to SEQ ID NO: 3485
  Description of Artificial Sequence: Synthetic light chain variable domain

SEQ ID NO: 5384 - protein, 219 aa, Artificial Sequence
  Description of Artificial Sequence: Synthetic light chain variable domain
DVVMTQTPLLLSVTIGQPASISCKSSQSLLDSDGKTYLNWLLQRTNGSPRRLIYLVSKLDSGVPDRFTGSGSGTDFTLKISRVEAEDIADYYCWQGTHFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5385 - protein, 219 aa, Artificial Sequence
  Description of Artificial Sequence: Synthetic light chain variable domain
DVVMTQTPLLLSVTIGQPASISCKSSQSLLDSDGKTYLNWLLQRTNGSPRRLIYLVSKLDSGVPDRFTGSGSGTDFTLKISRVEAEDEADYYCWQGTHFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 5386 - protein, 128 aa, Artificial Sequence
  Description of Artificial Sequence: Synthetic light chain variable domain
MTMFSLALLLSLLLLCVSDSRAETTVTQSPASLSMAGEKVTIRCITSNDIDDDMNWYQQKPGEPPKLLISEGNTLRPGVPSRFSSSGYGTDFVFTIEDILSEDVADYYCFQSDNLPYTFGGGTKLEIK

SEQ ID NO: 5387 - protein, 129 aa, Artificial Sequence
  Description of Artificial Sequence: Synthetic light chain variable domain
MTMFSLALLLSLLLLCVSDSRADIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIK

SEQ ID NO: 5388 - protein, 115 aa, Artificial Sequence
  Description of Artificial Sequence: Synthetic light chain variable domain
DIQLTQSPASLSVSAGEKVTMSCKSSQSLLNSGNQKNYLAWYQQKPGQPPKLLIHGASTRESGVPDRFTGSGSGTDFTLTISSVQAEDLAVYYCQNDYSYPLTFGAGTKLELKRL

SEQ ID NO: 5389 - protein, 107 aa, Artificial Sequence
  Description of Artificial Sequence: Synthetic light chain variable domain
DIVMTQSQKFMSSSVGDRVSVTCKASQNVNTNVAWYQQKQGQSPRPLIYSASSRCSGVPDRFTGSGFGTDFTLTISNVQSEDLAEYFCQQYHSFPLTFGAGAKLDLK

SEQ ID NO: 5390 - protein, 107 aa, Artificial Sequence
  Description of Artificial Sequence: Synthetic light chain variable domain
DIVMTQSHKFMSTSVGDRVSITCKASQDVGTAVAWYQQKPGQSPKLLIYWASTRHTGVPDRFTGSGSGTDFTLTISNVQSEDLADYFCQQYSSSLTFGAGATKLELK

SEQ ID NO: 5391 - protein, 107 aa, Artificial Sequence
  Description of Artificial Sequence: Synthetic light chain variable domain
DIQMTQSPSSLSASVGDRVTITCRASQSISYFLNWYQQKPGKAPKLLIYAASSLQSGVPSRFSGSGSGTDFTLTISSLQPEDFATYYCQQSYSTPPTFGGGTKVEIK

SEQ ID NO: 5392 - protein, 120 aa, Artificial Sequence
  Description of Artificial Sequence: Synthetic light chain variable domain
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARSYSNYVRYFDYWGQGTLVTVSS

SEQ ID NO: 5393 - protein, 107 aa, Artificial Sequence
  Description of Artificial Sequence: Synthetic light chain variable domain
EIQMTQTTSSLSASLGDRVTISCRASQDISNFLNWYQQKPDGTVKLLIYYTSTLHSGVPSRFSGSGSGTDYSLTISNLEQEDIATYFCQQGKTLPPTFGGGTKLEIK

SEQ ID NO: 5394 - protein, 106 aa, Artificial Sequence
  Description of Artificial Sequence: Synthetic light chain variable domain
DIVMTQSHKFMSTSVGDRVSITCKASQDVGSAVAWYQQKPGQSPKLLIYWASTRHTGVPDRFTGSGSGTDFTFTISNVQSEDLADYFCQQYSSSLTFGAGATKLEL

SEQ ID NO: 5395 - protein, 111 aa, Artificial Sequence
  Description of Artificial Sequence: Synthetic light chain variable domain
QSVLTQPPSASGTPGQRVTISCTGSSSNIGNNAVTWYQQLPGTAPKLLIYDDSHRPSGVPDRFSGSKSGTSASLAISGLRSEDEADYYCGTWDYSLSGYVFGGGTKLTVLG

SEQ ID NO: 5396 - protein, 111 aa, Artificial Sequence
  Description of Artificial Sequence: Synthetic light chain variable domain
QSVLTQPPSASGTPGQRVTISCTGSSSNIGSNNVTWYQQLPGTAPKLLIYSDSHRPSGVPDRFSGSKSGTSASLAISGLQSEDEADYYCGSWDYSLSAYVFGGGTKLTVLG

SEQ ID NO: 5397 - protein, 111 aa, Artificial Sequence
  Description of Artificial Sequence: Synthetic light chain variable domain
QSVLTQPPSASGTPGQRVTISCTGSSSNIGSNYVSWYQQLPGTAPKLLIYADSQRPSGVPDRFSGSKSGTSASLAISGLRSEDEADYYCGTWDYSLSGYVLGGGTKLTVLG

SEQ ID NO: 5398 - protein, 111 aa, Artificial Sequence
  Description of Artificial Sequence: Synthetic light chain variable domain
QSVLTQPPSASGAPGQRVTISCSGSSSNIGSNDVSWYQQLPGTAPKLLIYADSNRPSGVPDRFSGSKSGTSASLAISGLRSEDEADYYCGSWDYSLSGYVFGGGTKLTVLG

SEQ ID NO: 5399 - protein, 111 aa, Artificial Sequence
  Description of Artificial Sequence: Synthetic light chain variable domain
QSVLTQPPSSSGTPGQRVTISCTGSSSNIGSNAVTWYQQLPGTAPKLLIYDDNHRPSGVPDRFSGSKSGTSASLAISGLRSEDEADYYCGAWDYSLNAYVFGGGTKLTVLG

SEQ ID NO: 5400 - protein, 111 aa, Artificial Sequence
  Description of Artificial Sequence: Synthetic light chain variable domain
QSVLTQPPSASGTPGQRVIISCSASSSNIGSNAVYWYQQLPGTAPKLLIYSDNQRPSGVPDRFSGSKSGTSASLAISGLRSEDEADYYCGSWDYSLSAYVFGGGTKLTVLG

SEQ ID NO: 5401 - protein, 111 aa, Artificial Sequence
  Description of Artificial Sequence: Synthetic light chain variable domain
QSVLTQPPSLSGTPGQRVTISCTGSSSNIGSNSVSWYQQLPGTAPKLLIYDDNNRPSGVPDRFSGSKSGTSASLAISGLRSEDEADYYCGAWDYSLSAYVFGGGTKLTVLG

SEQ ID NO: 5402 - protein, 111 aa, Artificial Sequence
  Description of Artificial Sequence: Synthetic light chain variable domain
QSVLTQPPSPSGTPGQRVTISCTGSSSNIGNYYVYWYQQLPGTAPKLLIYANSHRPSGVPDRFSGSKSGTSASLAISGLRSEDEADYYCGSWDDSLSAYVFGGGTKLTVLG

SEQ ID NO: 5403 - protein, 163 aa, Artificial Sequence
  Description of Artificial Sequence: Synthetic light chain variable domain
DVVMTQSPLSLPVTLGQPASISCRSSQSLYYRDGYTFLDWYVQKPGQSPQLLIYLSSKRDSGVPDRISGSGSGTDFTLRISRVEAEDVGVYYCMQGTHWPYTFGQGTKLEIKRTVAAPSVFIFPPSDEQLKSGTASVVCLLNNFYPREAKVQWKVDNALQSGN

SEQ ID NO: 5404 - protein, 163 aa, Artificial Sequence
  Description of Artificial Sequence: Synthetic light chain variable domain
DVVMTQSPLSLPVTLGQPASISCRSSQSLYYRDGYTFLDWYVQKPGQSPQLLIYQSSKRDSGVPDRISGSGSGTDFTLRISRVEAEDVGVYYCMQGTHWPYTFGQGTKLEIKRTVAAPSVFIFPPSDEQLKSGTASVVCLLNNFYPREAKVQWKVDNALQSGN

SEQ ID NO: 5405 - protein, 163 aa, Artificial Sequence
  Description of Artificial Sequence: Synthetic light chain variable domain
DVVMTQSPLSLPVTLGQPASISCRSSQSLYYRDGYTFLDWYVQKPGQSPQLLIYRSSKRDSGVPDRISGSGSGTDFTLRISRVEAEDVGVYYCLQGTHWPYTFGQGTKLEIKRTVAAPSVFIFPPSDEQLKSGTASVVCLLNNFYPREAKVQWKVDNALQSGN

SEQ ID NO: 5406 - protein, 163 aa, Artificial Sequence
  Description of Artificial Sequence: Synthetic light chain variable domain
DVVMTQSPLSLPVTLGQPASISCRSSQSLYYRDGYTFLDWYVQKPGQSPQLLIYQSSKRDSGVPDRISGSGSGTDFTLRISRVEAEDVGVYYCLQGTHWPYTFGQGTKLEIKRTVAAPSVFIFPPSDEQLKSGTASVVCLLNNFYPREAKVQWKVDNALQSGN

SEQ ID NO: 5407 - protein, 163 aa, Artificial Sequence
  Description of Artificial Sequence: Synthetic light chain variable domain
DVVMTQSPLSLPVTLGQPASISCRSSQSLYYRDGYTFLDWYVQKPGQSPQLLIYQSSKRDSGVPDRISGSGSGTDFTLRISRVEAEDVGVYYCFQGTHWPYTFGQGTKLEIKRTVAAPSVFIFPPSDEQLKSGTASVVCLLNNFYPREAKVQWKVDNALQSGN

SEQ ID NO: 5408 - protein, 163 aa, Artificial Sequence
  Description of Artificial Sequence: Synthetic light chain variable domain
DVVMTQSPLSLPVTLGQPASISCRSSQSLYYRSGYTFLDWYVQKPGQSPQLLIYQSSKRDSGVPDRISGSGSGTDFTLRISRVEAEDVGVYYCMQGTHWPYTFGQGTKLEIKRTVAAPSVFIFPPSDEQLKSGTASVVCLLNNFYPREAKVQWKVDNALQSGN

SEQ ID NO: 5409 - protein, 163 aa, Artificial Sequence
  Description of Artificial Sequence: Synthetic light chain variable domain
DVVMTQSPLSLPVTLGQPASISCRSSQSLYYRSGYTFLDWYVQKPGQSPQLLIYQSSKRDSGVPDRISGSGSGTDFTLRISRVEAEDVGVYYCFQGTHWPYTFGQGTKLEIKRTVAAPSVFIFPPSDEQLKSGTASVVCLLNNFYPREAKVQWKVDNALQSGN

SEQ ID NO: 5410 - protein, 163 aa, Artificial Sequence
  Description of Artificial Sequence: Synthetic light chain variable domain
DVVMTQSPLSLPVTPGESASISCRSSQSLLHGNGNNYLDWYLQKPGQSPQLLIYLGSNRASGVPDRFSGSGSGTDFTLQISRVEPEDVGVYYCMQALQTPYTFGQGTKLEIKRTVAAPSVFIFPPSDEQLKSGTASVVCLLNNFYPREAKVQWKVDNALQSGN

SEQ ID NO: 5411 - protein, 158 aa, Artificial Sequence
  Description of Artificial Sequence: Synthetic light chain variable domain
DVVMTQSPSSLSASVGDRVTVTCRASQNIASYLNWYQQKPGKAPKLLIYAASSLKSGVPSRFSGSGSGRDFTLTISSLQPEDFAAYYCQQSYSIPYTFGQGTKVEIKRTVAAPSVFIFPPSDEQLKSGTASVVCLLNNFYPREAKVQWKVDNALQLGN

SEQ ID NO: 5412 - protein, 159 aa, Artificial Sequence
  Description of Artificial Sequence: Synthetic light chain variable domain
EIVLTQSPGTLSLSPGERATLSCRASQSVSNNYLGWYQQKPGQAPRLLIYGASSRATGVPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGN

SEQ ID NO: 5413 - protein, 163 aa, Artificial Sequence
  Description of Artificial Sequence: Synthetic light chain variable domain
DVVMTQSPLSLSVTPGEPASISCRSSQSLVYSDGKTYLDWFLQRPGQSPRRLIYKVSNRDSGVSDRFSGSGSGTDFTLKISRVEAEDVGVYYCMQGAHWPPTFGQGTRVEIKRTVAAPSVFIFPPSDEQLKSGTASVVCLLNNFYPREAKVQWKVDNALQSGN

SEQ ID NO: 5414 - protein, 159 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPARFSGSGSGTDFTLTISSLEPEDFAVYYCQQRSNWPPTFGPGTKVDIKRTVAAPSVFIFPPSDEQLKSGTASVVCLLNNFYPREAKVQWKVDNALQSGN

SEQ ID NO: 5415 - protein, 162 aa, Artificial Sequence
  Description of Artificial Sequence: Synthetic light chain variable domain
NFMLTQPHSVSESPGKTVTVSCTRSRGSIASSYVQWYQQRPGRSPTNVIYENDQRPSGVPTRFSGSVDRSSNSASLTISGLETEDEADYYCQSYDFSTVVFGGGTKLTVLSQPKAAPSVTLFPPSSEELQANKATLVCLISDFYPGAVTVAWKADSSPVKAG

SEQ ID NO: 5416 - protein, 159 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSVSGSGTDFTLTISRLEPEDFAVYYCQQYGSSPGTFGQGTKVEIKRTVAAPSVFIFPPSDEQLKSGTASVVCLLNNFYPREAKVQWKVDNALQSGN

SEQ ID NO: 5417 - protein, 163 aa, Artificial Sequence; identical to SEQ ID NO: 5403
  Description of Artificial Sequence: Synthetic light chain variable domain

SEQ ID NO: 5418 - protein, 163 aa, Artificial Sequence
  Description of Artificial Sequence: Synthetic light chain variable domain
DVVMTQSPLSLAVTPGEPASISCRSSQSLLYSNGYNYLDWYLQKPGQSPQLLIYLGSNRASGVPDRFSGSGSGTDFTLKISRVEAEDVGVYYCMQALQTPITFGPGTKVDIKRTVAAPSVFIFPPSDEQLKSGTASVVCLLNNFYPREAKVQWKVDNALQSGN

SEQ ID NO: 5419 - protein, 111 aa, Artificial Sequence
  Description of Artificial Sequence: Synthetic light chain variable domain
DIVMTQTPLSLSVTPGQPASISCRASESVDTYANSLMHWYLQKPGQPPQLLIYRASNLESGVPDRFSGSGSGTDFTLKISRVEAEDVGVYYCQQTNEDPRTFGQGTKLEIK

SEQ ID NO: 5420 - protein, 112 aa, Artificial Sequence
  Description of Artificial Sequence: Synthetic light chain variable domain
DIVMTQSPLSLPVTPGEPASISCRSSQTIVHSNGNTYLEWYLQKPGQSPQLLIYKVSNRFSGVPDRFSGSGSGTDFTLKISRVEAEDVGVYYCFQASHVPWTFGQGTKLEIK

SEQ ID NO: 5421 - protein, 112 aa, Artificial Sequence
  Description of Artificial Sequence: Synthetic light chain variable domain
DIVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPWTFGQGTKLEIK

SEQ ID NO: 5422 - protein, 107 aa, Artificial Sequence
  Description of Artificial Sequence: Synthetic light chain variable domain
DIQMTQSPSSLSASVGDRVTITCRASQSIDTRLNWYQQKPGKAPKLLIYSASSLQSGVPSRFSGSGSGTDFTLTISSLQPEDFATYYCQQSAYNPITFGQGTKVEIK

SEQ ID NO: 5423 - protein, 107 aa, Artificial Sequence
  Description of Artificial Sequence: Synthetic light chain variable domain
DIQMTQSPSSLSASVGDRVTITCRASQSINTNLNWYQQKPGKAPKLLIYAASSLQSGVPSRFSGSGSGTDFTLTISSLQPEDFATYYCQQARDTPITFGQGTKVEIK

SEQ ID NO: 5424 - protein, 128 aa, Artificial Sequence
  Description of Artificial Sequence: Synthetic light chain variable domain
MDLQVQIISFLLISASVIMSRGQIVLTQSPAIMSASPGEKVTITCSARSSVSYMHWFQQKPGTSPKLWIYRTSNLASGVPARFSGSGSGTSYCLTISRMEAEDAATYYCQQRSSFPLTFGSGTKLEIK

SEQ ID NO: 5425 - protein, 112 aa, Artificial Sequence
  Description of Artificial Sequence: Synthetic light chain variable domain
QSVLTQPPSVSGAPGQRVTISCTGSSSNIGAGYDVHWYQQLPGTAPKLLIYGNSNRPSGVPDRFSGSKSGTSASLAISGLQSEDEADYYCAAWDDSLNGYVFGTGTKLTVLG

SEQ ID NO: 5426 - protein, 119 aa, Artificial Sequence
  Description of Artificial Sequence: Synthetic light chain variable domain
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 5427 - protein, 216 aa, Artificial Sequence
  Description of Artificial Sequence: Synthetic light chain variable domain
QAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 5428 - protein, 108 aa, Artificial Sequence
  Description of Artificial Sequence: Synthetic light chain variable domain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIKR

SEQ ID NO: 5429 - protein, 111 aa, Artificial Sequence
  Description of Artificial Sequence: Synthetic light chain variable domain
QAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLG

SEQ ID NO: 5430 - protein, 107 aa, Artificial Sequence
  Description of Artificial Sequence: Synthetic light chain variable domain
DIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKR

SEQ ID NO: 5431 - protein, 109 aa, Artificial Sequence
  Description of Artificial Sequence: Synthetic light chain variable domain
QSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 5432 - protein, 107 aa, Artificial Sequence
  Description of Artificial Sequence: Synthetic light chain variable domain
DIQLTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK

SEQ ID NO: 5433 - protein, 105 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFGQGTKLEIK

SEQ ID NO: 5434 - protein, 112 aa, Artificial Sequence
  Description of Artificial Sequence: Synthetic light chain variable domain
EIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKR

SEQ ID NO: 5435 - protein, 111 aa, Artificial Sequence; identical to SEQ ID NO: 3106
  Description of Artificial Sequence: Synthetic light chain variable domain

SEQ ID NO: 5436 - protein, 112 aa, Artificial Sequence; identical to SEQ ID NO: 3107
  Description of Artificial Sequence: Synthetic light chain variable domain

SEQ ID NO: 5437 - protein, 107 aa, Artificial Sequence; identical to SEQ ID NO: 3108
  Description of Artificial Sequence: Synthetic light chain variable domain

SEQ ID NO: 5438 - protein, 107 aa, Artificial Sequence; identical to SEQ ID NO: 3112
  Description of Artificial Sequence: Synthetic light chain variable domain

SEQ ID NO: 5439 - protein, 112 aa, Artificial Sequence; identical to SEQ ID NO: 3109
  Description of Artificial Sequence: Synthetic light chain variable domain

SEQ ID NO: 5440 - protein, 111 aa, Artificial Sequence; identical to SEQ ID NO: 3110
  Description of Artificial Sequence: Synthetic light chain variable domain

SEQ ID NO: 5441 - protein, 112 aa, Artificial Sequence; identical to SEQ ID NO: 3111
  Description of Artificial Sequence: Synthetic light chain variable domain

SEQ ID NO: 5442 - protein, 134 aa, Artificial Sequence; identical to SEQ ID NO: 3299
  Description of Artificial Sequence: Synthetic light chain variable domain

SEQ ID NO: 5443 - protein, 132 aa, Artificial Sequence; identical to SEQ ID NO: 773
  Description of Artificial Sequence: Synthetic light chain variable domain

SEQ ID NO: 5444 - protein, 107 aa, Artificial Sequence; identical to SEQ ID NO: 3300
  Description of Artificial Sequence: Synthetic light chain variable domain

SEQ ID NO: 5445 - protein, 111 aa, Artificial Sequence; identical to SEQ ID NO: 3301
  Description of Artificial Sequence: Synthetic light chain variable domain

SEQ ID NO: 5446 - protein, 113 aa, Artificial Sequence
  Description of Artificial Sequence: Synthetic light chain variable domain
DIMMSQSPSSLAVSVGEKFTMTCKSSQSLFFGSTQKNYLAWYQQKPGQSPKLLIYWASTRESGVPDRFTGSGSGTDFTLAISSVMPEDLAVYYCQQYYNYPWTFGGGTKLEIK

SEQ ID NO: 5447 - protein, 111 aa, Artificial Sequence
  Description of Artificial Sequence: Synthetic light chain variable domain
DIVLTQSPASLAVSLGQRATISCKASQSVDFDGDSFMNWYQQKPGQPPKLLIYTTSNLESGIPARFSASGSGTDFTLNIHPVEEEDTATYYCQQSNEDPYTFGGGTKLEIK

SEQ ID NO: 5448 - protein, 108 aa, Artificial Sequence
  Description of Artificial Sequence: Synthetic light chain variable domain
DIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 5449 - protein, 110 aa, Artificial Sequence
  Description of Artificial Sequence: Synthetic light chain variable domain
EIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIK

SEQ ID NO: 5450 - protein, 109 aa, Artificial Sequence
  Description of Artificial Sequence: Synthetic light chain variable domain
EIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIK

SEQ ID NO: 5451 - protein, 108 aa, Artificial Sequence
  Description of Artificial Sequence: Synthetic light chain variable domain
DIQMTQSPASLSVSVGETVTITCRTNENIYSNLAWYQQKQGKSPQLLIYAATHLVEGVPSRFSGSGSGTQYSLKITSLQSEDFGNYYCQHFWGTPCTFGGGTKLEIKR

SEQ ID NO: 5452 - protein, 214 aa, Artificial Sequence
  Description of Artificial Sequence: Synthetic light chain variable domain
EIVLTQSPATLSLSPGERATLSCRASQGVSSYLAWYQQKPGQAPRLLIYDASNRATGIPARFSGSGPGTDFTLTISSLEPEDFAVYYCQQRSNWHLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5453 - protein, 214 aa, Artificial Sequence
  Description of Artificial Sequence: Synthetic light chain variable domain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5454 - protein, 214 aa, Artificial Sequence
  Description of Artificial Sequence: Synthetic light chain variable domain
EIVLTQSPGTLSLSPGERATLSCRASQSVSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5455 - protein, 214 aa, Artificial Sequence
  Description of Artificial Sequence: Synthetic light chain variable domain
DIQMTQSPSSLSASVGDRVTFTCRASQGISSWLAWYQQKPEKAPKSLIYAASSLQSGVPSRFSGSGSGTDFTLTISSLQPEDFATYYCQQYNSYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5456 - protein, 213 aa, Artificial Sequence
  Description of Artificial Sequence: Synthetic light chain variable domain
AIQLTQSPSSLSASVGDRVTITCRASQGISSALAWYQQKPGKAPKLLIYDASSLESGVPSRFSGSGSGTDFTLTISSLQPEDFATYYCQQFNSYPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5457 - protein, 214 aa, Artificial Sequence
  Description of Artificial Sequence: Synthetic light chain variable domain
AIQLTQSPSSLSASVGDRVTITCRASQGISSALAWYQQKPGKAPKLLIYDASSLESGVPSRFSGSGSGTDFTLTISSLQPEDFATYYCQQFSSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5458 - protein, 214 aa, Artificial Sequence
  Description of Artificial Sequence: Synthetic light chain variable domain
DIQMTQSPSSLSASVGDRVTITCRASQGISSWLAWYQQKPEKAPKSLIYAASSLQSGVPSRFSGSGSGTGFTLTISSLQPEDFATYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5459 - protein, 214 aa, Artificial Sequence
  Description of Artificial Sequence: Synthetic light chain variable domain
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5460 - protein, 214 aa, Artificial Sequence
  Description of Artificial Sequence: Synthetic light chain variable domain
DIQMTQSPSSLSASVGDRVTITCRASQYISSWLAWYQQKPEKAPKSLIYAASSLQSGVPSRFSGSGSGTDFTLTISSLQPEDFATYYCQQYHSYPPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5461 - protein, 111 aa, Artificial Sequence; identical to SEQ ID NO: 3759
  Description of Artificial Sequence: Synthetic light chain variable domain

SEQ ID NO: 5462 - protein, 113 aa, Artificial Sequence
  Description of Artificial Sequence: Synthetic light chain variable domain
DIQLTQTPLSLPVSLGDQASISCRSSQSLVHRNGNTYLHWYLQKPGQSPKLLIYTVSNRFSGVPDRFSGSGSGTDFTLKISRVEAEDLGLYFCSQSSHVPPTFGAGTKLEIKR

SEQ ID NO: 5463 - protein, 111 aa, Artificial Sequence; identical to SEQ ID NO: 3755
  Description of Artificial Sequence: Synthetic light chain variable domain

SEQ ID NO: 5464 - protein, 113 aa, Artificial Sequence; identical to SEQ ID NO: 3757
  Description of Artificial Sequence: Synthetic light chain variable domain

SEQ ID NO: 5465 - protein, 107 aa, Artificial Sequence; identical to SEQ ID NO: 3964
  Description of Artificial Sequence: Synthetic light chain variable domain

SEQ ID NO: 5466 - protein, 108 aa, Artificial Sequence; identical to SEQ ID NO: 3965
  Description of Artificial Sequence: Synthetic light chain variable domain

SEQ ID NO: 5467 - protein, 240 aa, Artificial Sequence
  Description of Artificial Sequence: Synthetic light chain variable domain
EIKLTQSPSILSVSPGETVTLSCRASQTIYKNLHWYQQKSHRSPRLLIKYGSDSISGIPARFSGSGSGTDYTLTINSVKPEDEGIYYCLQGYSTPWTFGQGTKLEIKRTVAAPSVFIFPPSDEQLKSGTASVVCLLNNFYPREAKVQWKVDNALQSGNSQESVTEQDSKDSTYSLSSTLTLSKADPGVRDRAGLQGLHLLPSSTLTLSKADYEKHKVYACEVTHQGLSSPVTKSFNRGEC

SEQ ID NO: 5468 - protein, 214 aa, Artificial Sequence
  Description of Artificial Sequence: Synthetic light chain variable domain
EIVLTQSPATLSVSPGETVTLSCRASQTIYKNLHWYQQKSGLSPRLLIKYGSDSISGIPARFSGSGSGTDYTLTINSVEPEDEGIYYCLQGYSTPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5469 - protein, 107 aa, Artificial Sequence; identical to SEQ ID NO: 4664
  Description of Artificial Sequence: Synthetic light chain variable domain

SEQ ID NO: 5470 - protein, 108 aa, Artificial Sequence; identical to SEQ ID NO: 4661
  Description of Artificial Sequence: Synthetic light chain variable domain

SEQ ID NO: 5471 - protein, 107 aa, Artificial Sequence [sequence omitted]

SEQ ID NO: 5472 - protein, 112 aa, Artificial Sequence
  Description of Artificial Sequence: Synthetic light chain variable domain
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIK

SEQ ID NO: 5473 - protein, 107 aa, Artificial Sequence; identical to SEQ ID NO: 5039
  Description of Artificial Sequence: Synthetic light chain variable domain

SEQ ID NO: 5474 - protein, 247 aa, Artificial Sequence
  Description of Artificial Sequence: Synthetic single chain variable fragment sequence
MAQVQLVQSGAEVKEPGSSVKVSCKASGGTFSSYAIYWVRQAPGQGLEWMGWINPDSGDTNSAQQFQGRVTMTRDTSISTAYMELSRLRSDDTAMYYCARPPRGDGPDYWGQGTLVTVSSGGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVDIKRGLGGLVDYKDDD

SEQ ID NO: 5475 - protein, 261 aa, Artificial Sequence [sequence omitted]

SEQ ID NO: 5476 - protein, 249 aa, Artificial Sequence
  Description of Artificial Sequence: Synthetic single chain variable fragment sequence
MAQVQLVQSGAEVKEPGSSVKVSCKASGGTFSSYAIYWVRQAPGQGLEWMGWINPDSGDTNSAQQFQGRVTMTRDTSISTAYMELSRLRSDDTAMYYCARPPRGDGPDYWGQGTLVTVSSGGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVDIKRGLGGLVDYKDDDDK

SEQ ID NO: 5477 - protein, 258 aa, Artificial Sequence
  Description of Artificial Sequence: Synthetic single chain variable fragment sequence
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGSTSGSGKPGSGEGSTKGEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSC

SEQ ID NO: 5478 - protein, 258 aa, Artificial Sequence; identical to SEQ ID NO: 5477
  Description of Artificial Sequence: Synthetic single chain variable fragment sequence

SEQ ID NO: 5479 - protein, 246 aa, Artificial Sequence
  Description of Artificial Sequence: Synthetic single chain variable fragment sequence
DVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIK

SEQ ID NO: 5480 - protein, 246 aa, Artificial Sequence
  Description of Artificial Sequence: Synthetic single chain variable fragment sequence
QVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIK

SEQ ID NO: 5481 - protein, 245 aa, Artificial Sequence
  Description of Artificial Sequence: Synthetic single chain variable fragment sequence
DVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIK

SEQ ID NO: 5482 - protein, 242 aa, Artificial Sequence
  Description of Artificial Sequence: Synthetic single chain variable fragment sequence
ALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEIN

SEQ ID NO: 5483 - protein, 248 aa, Artificial Sequence
  Description of Artificial Sequence: Synthetic single chain variable fragment sequence
QVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKR

SEQ ID NO: 5484 - protein, 247 aa, Artificial Sequence
  Description of Artificial Sequence: Synthetic single chain variable fragment sequence
QVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKR

SEQ ID NO: 5485 - protein, 246 aa, Artificial Sequence
  Description of Artificial Sequence: Synthetic single chain variable fragment sequence
QVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKR

SEQ ID NO: 5486 - protein, 246 aa, Artificial Sequence; identical to SEQ ID NO: 5479
  Description of Artificial Sequence: Synthetic single chain variable fragment sequence

SEQ ID NO: 5487 - protein, 246 aa, Artificial Sequence; identical to SEQ ID NO: 5480
  Description of Artificial Sequence: Synthetic single chain variable fragment sequence

SEQ ID NO: 5488 - protein, 245 aa, Artificial Sequence; identical to SEQ ID NO: 5481
  Description of Artificial Sequence: Synthetic single chain variable fragment sequence

SEQ ID NO: 5489 - protein, 242 aa, Artificial Sequence; identical to SEQ ID NO: 5482
  Description of Artificial Sequence: Synthetic single chain variable fragment sequence

SEQ ID NO: 5490 - protein, 248 aa, Artificial Sequence; identical to SEQ ID NO: 5483
  Description of Artificial Sequence: Synthetic single chain variable fragment sequence

SEQ ID NO: 5491 - protein, 247 aa, Artificial Sequence; identical to SEQ ID NO: 5484
  Description of Artificial Sequence: Synthetic single chain variable fragment sequence

SEQ ID NO: 5492 - protein, 246 aa, Artificial Sequence; identical to SEQ ID NO: 5485
  Description of Artificial Sequence: Synthetic single chain variable fragment sequence

SEQ ID NO: 5493 - protein, 243 aa, Artificial Sequence
  Description of Artificial Sequence: Synthetic single chain variable fragment sequence
QVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKR

SEQ ID NO: 5494 - protein, 242 aa, Artificial Sequence
  Description of Artificial Sequence: Synthetic single chain variable fragment sequence
QVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKR

SEQ ID NO: 5495 - protein, 200 aa, Artificial Sequence
  Description of Artificial Sequence: Synthetic single chain variable fragment sequence
  MOD_RES (3)..(5): Any amino acid
  MOD_RES (170)..(171): Any amino acid
QVXXXQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYXXKSHESPRLLIKYASQSISGIPARFSGSGS

SEQ ID NO: 5496 - protein, 200 aa, Artificial Sequence
  Description of Artificial Sequence: Synthetic single chain variable fragment sequence
  MOD_RES (2)..(5): Any amino acid
QXXXXQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGS

SEQ ID NO: 5497 - protein, 200 aa, Artificial Sequence
  Description of Artificial Sequence: Synthetic single chain variable fragment sequence
  MOD_RES (3)..(5): Any amino acid
QVXXXQSGAEVVKPGASVKLSCKTSGYTFTNYDINWVRQRPGQGLEWIGWIFPGDDSTQYNEKFKGKATLTTDTSTSTAYMELSSLRSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSIPGIPARFSGSGS

SEQ ID NO: 5498 - protein, 200 aa, Artificial Sequence
  Description of Artificial Sequence: Synthetic single chain variable fragment sequence
  MOD_RES (3)..(3): Any amino acid
  MOD_RES (5)..(5): Any amino acid
QVXLXQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 5499 - protein, 200 aa, Artificial Sequence
  Description of Artificial Sequence: Synthetic single chain variable fragment sequence
  MOD_RES (3)..(3): Any amino acid
QVXLVQSGAEVVKPGASVKLSCKTSGYTFTNYDINWVRQRPGQGLEWIGWIFPGDGSTQYNEKFKGKATLTTDTSTSTAYMELSSLGSEDTAVYFCTRQTTATWFAYWGQGTLVTVSSGGGGSGGGGSSGGGSEIVMTQSPATLSVSPGERVTLSCRASQSIGDYLYWYQQKSHESPRLLIKYASQSISGIPARFSGSGS

SEQ ID NO: 5500 - protein, 200 aa, Artificial Sequence
  Description of Artificial Sequence: Synthetic single chain variable fragment sequence
  MOD_RES (3)..(3): Any amino acid
  MOD_RES (5)..(5): Any amino acid
QVXLXQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 5501 - protein, 241 aa, Artificial Sequence
  Description of Artificial Sequence: Synthetic single chain variable fragment sequence
QVQLVQSGAEVVKPGASVKLSCKASGYTFTNYDINWVRQRPEQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVSLSCRASQSISDYLHWYQQKSHESPRLLIKYASQSISGIPARFSGSGSGSEFTLTINSVEPEDVGVYYCQNGHSFPLTFGQGTKLELKR

SEQ ID NO: 5502 - protein, 241 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGSGSEFTLTINSVEPEDVGVYYCQNGHSFPLTFGQGTKLELKR

SEQ ID NO: 5503 - protein, 241 aa, Artificial Sequence
  Description of Artificial Sequence: Synthetic single chain variable fragment sequence
QVQLVQSGAEVVKPGASCKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGSGSEFTLTINSVEPEDVGVYYCQNGHSFPLTFGQGTKLELKR

SEQ ID NO: 5504 - protein, 241 aa, Artificial Sequence
  Description of Artificial Sequence: Synthetic single chain variable fragment sequence
QVQLVQSGAEVVKPGASVKLSCKTSGYTFTNYDINWVRQRPGQGLEWVGWIFPGDGSTQYNEKFKGKATLTTDTSTSTAYMELSSLRSEDTAVYFCARQTTSTWFAYWGQGTLVTVSSGGGGSGGGGSGGGGSEIVMTQSPATLSVSPGERVTLSCRASQPISDYLYWYQQKSHESPRLLIKYASQSISGIPARFSGSGSGSEFTLTINSVEPEDVGVYYCQNGYSFPLTFGQGTKLELKR

SEQ ID NO: 5505 - protein, 241 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDDSTQYNEKFKGKATLTTDTSTSTAYMELSSLRPEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSIPGIPARFSGSGSGSEFTLTINSVEPEDVGVYYCQNGHSFPLTFGQGTKLELKR

SEQ ID NO: 5506 - protein, 241 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDGSTQYNEKFKGKATLTTDTSTSTAYMELSSLGSEDTAVYFCTRQTTATWFAYWGQGTLVTVSSGGGGSGGGGSSGGGSEIVMTQSPATLSVSPGERVTLSCRASQSIGDYLYWYQQKSHESPRLLIKYASQSISGIPARFSGSGSGSEFTLTINSVEPEDVGVYYCQNGHSFPLTFGQGTKLELKR

SEQ ID NO: 5507 - protein, 241 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGSGSEFTLTINSVEPEDVGVYYCQNGHSFPLTFGQGTKLELKR

SEQ ID NO: 5508 - protein, 241 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDDSTQYNEKFKGKATLTTDTSTSTAYMELSSLRSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGSGSEFTLTINSVEPEDVGVYYCQNGHSFPLTFGQGTKLELKR

SEQ ID NO: 5509 - protein, 241 aa, Artificial Sequence
  Description of Artificial Sequence: Synthetic single chain variable fragment sequence
QVQLVQSGAEVVKPGASVKVSCKASGYTFTNYDINWVRQRPEQGLEWIGWIFPGDGSTQYNEKFKGRVTMTTDTSTSTVYMELSSLRSEDTAVYFCARQTTATWFAYWGQGTLVTVSSGGGGSGGGGSGGGGSEIVMTQSPATLSVSPGERVTLSCRASQSISDYLHWYQQKSHQAPRLLIKYASQSISGIPARFSGSGSGSEFTLTISSLQPEDFGVYYCQNGHSFPLTFGQGTKLELKR

SEQ ID NO: 5510 - protein, 241 aa, Artificial Sequence
  Description of Artificial Sequence: Synthetic single chain variable fragment sequence
QVQLVQSGAEVVKPGASVKVSCKTSGYTFTNYDINWVRQRPGQGLEWIGWIFPGDDSTQYNEKFKGRVTMTTDTSTSTVYMELSSLRSEDTAVYFCARQTTGTWFAYWGQGTLVTVSSGGGGSGGGGSGGGGSEIVMTQSPATLSVSPGERVTLSCRASQSISDYLYWYQQKSHQAPRLLIKYASQSISGIPARFSGSGSGSEFTLTISSLQPEDFGVYYCQNGHSFPLTFGQGTKLELKR

SEQ ID NO: 5511 - protein, 241 aa, Artificial Sequence
  Description of Artificial Sequence: Synthetic single chain variable fragment sequence
QVQLQQSGAELVKPGASVKLSCKTSGYTFTNYDINWVRQRPGQGLEWIGWIFPGDDSTQYNEKFKGKATLTTDTSSSTAYMQLSRLTSEDSAVYFCARQTTGTWFAYWGQGTLVTVSAGGGGSGGGGSGGGGSDIVMTQSPATLSVTPGDRVTLSCRASQSISDYLYWYQQKSHESPRLLIKYASQSISGIPSRFSGSGSGSDFTLSINSVEPEDVGVYYCQNGHSFPLTFGAGTKLELKR

SEQ ID NO: 5512 - protein, 200 aa, Artificial Sequence
  Description of Artificial Sequence: Synthetic single chain variable fragment sequence
QVQLVQSGAEVVKPGASVKLSCKASGYTFTNYDINWVRQRPEQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVSLSCRASQSISDYLHWYQQKSHESPRLLIKYASQSISGIPARFSGSGS

SEQ ID NO: 5513 - protein, 200 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 5514 - protein, 200 aa, Artificial Sequence
  Description of Artificial Sequence: Synthetic single chain variable fragment sequence
  MOD_RES (3)..(4): Any amino acid
  MOD_RES (18)..(18): Any amino acid
QVXXVQSGAEVVKPGASXKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGS

SEQ ID NO: 5515 - protein, 200 aa, Artificial Sequence
  Description of Artificial Sequence: Synthetic single chain variable fragment sequence
  MOD_RES (3)..(3): Any amino acid
QVXLVQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 5516 - protein, 200 aa, Artificial Sequence
  Description of Artificial Sequence: Synthetic single chain variable fragment sequence
  MOD_RES (3)..(3): Any amino acid
QVXLVQSGAEVVKPGASVKLSCKTSGYTFTNYDINWVRQRPGQGLEWIGWIFPGDGSTQYNEKFKGKATLTTDTSTSTAYMELSSLRSEDTAVYFCARQTTATWFAYWGQGTLVTVSSGGGGSGGGGSGGVGSEIVMTQSPATLSVSPGERVTLSCRASQSIGDYLYWYQQKSHESPRLLIKYASQSISGIPARFSGSGS

SEQ ID NO: 5517 - protein, 200 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDGSTQYNEKFKGKATLTTDTSTSTAYMELSSLGSEDTAVYFCARQTTATWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 5518 - protein, 200 aa, Artificial Sequence
  Description of Artificial Sequence: Synthetic single chain variable fragment sequence
  MOD_RES (3)..(3): Any amino acid
QVXLVQSGAEVVKPGASVKLSCKASGYTFTNYDINWARQRPGQGLEWIGWIFPGDGSTQYNEKFKGKATLTTDTSTGTAYMELSSLRSEDTAVYFCARQTTATWFAYWGQGTVVTVSSGGGGSGGGGSGGGGNEIVMTQSPATLSVSPGERVTLSCRASQSISDYVYWYQQKPHESPRLLIKYASQSISGIPARFSGSGS

SEQ ID NO: 5519 - protein, 200 aa, Artificial Sequence; identical to SEQ ID NO: 5500
  Description of Artificial Sequence: Synthetic single chain variable fragment sequence
  MOD_RES (3)..(3): Any amino acid
  MOD_RES (5)..(5): Any amino acid

SEQ ID NO: 5520 - protein, 200 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDGSTQYNEKFKGKATLTTDTSTSTAYMELSSLSSEDTAVYFCARQTTATWFAYWGQGTLVTVSSGGGGSGGGGSGGGGSEIVMTQSPATLSVSPGERVTLSCRASQEISDYLYWYQQKSHESPRLLIKYASQSISGIPARFSGSGS

SEQ ID NO: 5521 - protein, 200 aa, Artificial Sequence
  Description of Artificial Sequence: Synthetic single chain variable fragment sequence
QVQLVQSGAEVVKPGASVKLSCKTSGYTFTNYDINWVRQRPGQGLEWVGWIFPGDGSTQYNEKFKGKATLTTDTSTSTAYMELSSLRSEDTAVYFCARQTTSTWFAYWGQGTLVTVSSGGGGSGGGGSGGGGSEIVMTQSPATLSVSPGERVTLSCRASQEISDYLYWYQQKSHESPRLLIKYASQSISGIPARFSGSGS

SEQ ID NO: 5522 - protein, 200 aa, Artificial Sequence
  Description of Artificial Sequence: Synthetic single chain variable fragment sequence
QVQLVQSGAEVVKPGASVKLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 5523 - protein, 200 aa, Artificial Sequence
  Description of Artificial Sequence: Synthetic single chain variable fragment sequence
  MOD_RES (2)..(6): Any amino acid
  MOD_RES (17)..(19): Any amino acid
QXXXXXSGAEVVKPGAXXXLSCKTSGYTFTNYDINWVRQRPGQGLEWIGWIFPGDGSTQYNEKFKGKATLTTDTSTSTAYLELSSLGSEDTAVYFCARQTTGTWFAYWGQGTLVTVSSGGGGSGGGGSGGGGSEIVMTQSPATLSVSPGERVTLSCRASQSISDYLYWYQQKSHESPRLLIKYASQSISGIPARFSGSGS

SEQ ID NO: 5524 - protein, 263 aa, Artificial Sequence
  Description of Artificial Sequence: Synthetic single chain variable fragment sequence
QPVLTQSHTVTITCTGYVQWYQQRSVSESPGKSGGNIATQPGSGPTTVIYDDDQRPSGVPDRFTGSIDSSSNSASLTISGLKTEDEADYYCQSYDSTNHGVFGGGAKVTVLGGSSRSSSSGGGGSGGGGQVQLQQWGPGLVKPSETLSLTCTVSGGSISSSSYYWGWIRQPPGKGLEWIGSIYYSGSTYYNPSLKSRVTISVDTSKNQFSLKLSSVTAADTAVYYCARLSKGYSSSWAYSYYGPDAWGQGTMVTVSSFEGSEQ

SEQ ID NO: 5525 - protein, 253 aa, Artificial Sequence
  Description of Artificial Sequence: Synthetic single chain variable fragment sequence
DIVMTQTPATLSVSPGKRATLSCRASQSVSSNYLAWYQQKPGQAPRLLIYGASRRATGIPDRFSGSGSGTDFTLTISSLQAEDVAVYYCQQYGSSPRTFGQGTKLEIKGGSSRSSSSGGGGSGGGGQVTLKESGAEVKNPGSSVKVSCKASGGTFSSYAISWLRQAPGQGLEWMGWINPNSGGSDYAQRFQGRVTMTRDTSINTVYMELSRLRSDDTAVYYCARVEKRGYYYGMDVWGQGTMVTVSSFEGSEQ

SEQ ID NO: 5526 - protein, 254 aa, Artificial Sequence
  Description of Artificial Sequence: Synthetic single chain variable fragment sequence
RPVLTQPPSAAGTPGQRVTISCSGSSSNIGSNYVYWYQQLPGMAPKLLIYTNNQRPSGVPGRFSGSKSGTSASLAISGLRSEDEADYYCAAWDDSLNGWVFGGGTELTVLGGSSRSSSSGGGGSGGGGQVQLQESGPGLVKPSETLSLTCNVSGRSVSSGFYWSWIRQRPGKGLEWVGSIYRSGLTYYNPSLKSRVTISVDTSKNQFSLKLSSVTAADTAVYYCARATPWYYYGMDVWGQGTTVTVSSFEGSEQ

SEQ ID NO: 5527 - protein, 255 aa, Artificial Sequence
  Description of Artificial Sequence: Synthetic single chain variable fragment sequence
QPGLTQPPSASGTPGQRVTISCSGSSSNIGSNYVYWYQQFPGTAPKLLIYRNNQRPSGVPDRFSGSKSGTSASLAISGLRSEDEADYYCAAWDDSLSVWVFGGGTKVTVLGGSSRSSSSGGSGSGGGGQVTLKESGAEVKNPGSSVKVSCKASGGTFSSYAISWLRQAPGQGLEWMGWINPNSGGSDYAQRFQGRVTMTRDTSINTVYMELSRLRSDDTAVYYCARVEKRGYYYGMDVWGQGTMVTVSSFEGSEQ

SEQ ID NO: 5528 - protein, 263 aa, Artificial Sequence
  Description of Artificial Sequence: Synthetic single chain variable fragment sequence
QPVLTQSHSVSESPGKTVTITCTGSGGNIATQYVQWYQQRPGSGPTTVIYDDDQRPSGVPDRFTGSIDSSSNSASLTISGLKTEDEADYYCQSYDSTNHGVFGGGAKVTVLGGSSRSSSSGGGGSGGGGQVQLQQWGPGLVKPSETLSLTCTVSGGSISSSSYYWGWIRQPPGKGLEWIGSIYYSGSTYYNPSLKSRVTISVDTSKNQFSLKLSSVTAADTAVYYCARLSKGYSSSWAYSYYGPDAWGQGTMVTVSSFEGSEQ

SEQ ID NO: 5529 - protein, 243 aa, Artificial Sequence
  Description of Artificial Sequence: Synthetic single chain variable fragment sequence
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 5530 - protein, 248 aa, Artificial Sequence
  Description of Artificial Sequence: Synthetic single chain variable fragment sequence
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYGSKRASGVPDRFSGSGSGTDFTLHITRVGAEDVGVYYCMQALQTPYTFGQGTKLEIK

SEQ ID NO: 5531 - protein, 238 aa, Artificial Sequence
  Description of Artificial Sequence: Synthetic single chain variable fragment sequence
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 5532 - protein, 239 aa, Artificial Sequence
  Description of Artificial Sequence: Synthetic single chain variable fragment sequence
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 5533 - protein, 241 aa, Artificial Sequence
  Description of Artificial Sequence: Synthetic single chain variable fragment sequence
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 5534 - protein, 238 aa, Artificial Sequence
  Description of Artificial Sequence: Synthetic single chain variable fragment sequence
EVQLVESGGGLVQPGGSLRLSCAVSGFALSNHGMSWVRRAPGKGLEWVSGIVYSGSTYYAASVKRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 5535 - protein, 239 aa, Artificial Sequence
  Description of Artificial Sequence: Synthetic single chain variable fragment sequence
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 5536 - protein, 240 aa, Artificial Sequence
  Description of Artificial Sequence: Synthetic single chain variable fragment sequence
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 5537 - protein, 241 aa, Artificial Sequence
  Description of Artificial Sequence: Synthetic single chain variable fragment sequence
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 5538 - protein, 241 aa, Artificial Sequence
  Description of Artificial Sequence: Synthetic single chain variable fragment sequence
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 5539 - protein, 248 aa, Artificial Sequence
  Description of Artificial Sequence: Synthetic single chain variable fragment sequence
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 5540 - protein, 248 aa, Artificial Sequence
  Description of Artificial Sequence: Synthetic single chain variable fragment sequence
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 5541 - protein, 238 aa, Artificial Sequence
  Description of Artificial Sequence: Synthetic single chain variable fragment sequence
EVQLVETGGGLVQPGRSLRLSCAASGFTFDDYAMHWVRQAPGKGLEWVSGISWNSGSIGYADSVGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 5542 - protein, 241 aa, Artificial Sequence
  Description of Artificial Sequence: Synthetic single chain variable fragment sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 5543 - protein, 248 aa, Artificial Sequence
  Description of Artificial Sequence: Synthetic single chain variable fragment sequence
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 5544 - protein, 250 aa, Artificial Sequence
  Description of Artificial Sequence: Synthetic single chain variable fragment sequence
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYTSSRATGISDRFSGSGSGTDFTLTISRLEPEDFAVYYCQHYGNSPPKFTFGPGTKLEIK

SEQ ID NO: 5545 - protein, 243 aa, Artificial Sequence
  Description of Artificial Sequence: Synthetic single chain variable fragment sequence
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 5546 - protein, 244 aa, Artificial Sequence
  Description of Artificial Sequence: Synthetic single chain variable fragment sequence
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 5547 - protein, 246 aa, Artificial Sequence
  Description of Artificial Sequence: Synthetic single chain variable fragment sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 5548 - protein, 240 aa, Artificial Sequence
  Description of Artificial Sequence: Synthetic single chain variable fragment sequence
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 5549 - protein, 241 aa, Artificial Sequence
  Description of Artificial Sequence: Synthetic single chain variable fragment sequence
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 5550 - protein, 245 aa, Artificial Sequence
  Description of Artificial Sequence: Synthetic single chain variable fragment sequence
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 5551 - protein, 253 aa, Artificial Sequence
  Description of Artificial Sequence: Synthetic single chain variable fragment sequence
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 5552 - protein, 248 aa, Artificial Sequence
  Description of Artificial Sequence: Synthetic single chain variable fragment sequence
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 5553 - protein, 241 aa, Artificial Sequence; identical to SEQ ID NO: 5538
  Description of Artificial Sequence: Synthetic single chain variable fragment sequence

SEQ ID NO: 5554 - protein, 248 aa, Artificial Sequence; identical to SEQ ID NO: 5539
  Description of Artificial Sequence: Synthetic single chain variable fragment sequence

SEQ ID NO: 5555 - protein, 248 aa, Artificial Sequence; identical to SEQ ID NO: 5540
  Description of Artificial Sequence: Synthetic single chain variable fragment sequence

SEQ ID NO: 5556 - protein, 239 aa, Artificial Sequence
  Description of Artificial Sequence: Synthetic single chain variable fragment sequence
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 5557 - protein, 246 aa, Artificial Sequence
  Description of Artificial Sequence: Synthetic single chain variable fragment sequence
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 5558 - protein, 241 aa, Artificial Sequence; identical to SEQ ID NO: 5542
  Description of Artificial Sequence: Synthetic single chain variable fragment sequence

SEQ ID NO: 5559 - protein, 242 aa, Artificial Sequence
  Description of Artificial Sequence: Synthetic single chain variable fragment sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 5560 - protein, 248 aa, Artificial Sequence; identical to SEQ ID NO: 5543
  Description of Artificial Sequence: Synthetic single chain variable fragment sequence

SEQ ID NO: 5561 - protein, 244 aa, Artificial Sequence
  Description of Artificial Sequence: Synthetic single chain variable fragment sequence
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 5562 - protein, 244 aa, Artificial Sequence
  Description of Artificial Sequence: Synthetic single chain variable fragment sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 5563 - protein, 251 aa, Artificial Sequence
  Description of Artificial Sequence: Synthetic single chain variable fragment sequence
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 5564 - protein, 246 aa, Artificial Sequence
  Description of Artificial Sequence: Synthetic single chain variable fragment sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 5565 - protein, 244 aa, Artificial Sequence
  Description of Artificial Sequence: Synthetic single chain variable fragment sequence
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 5566 - protein, 249 aa, Artificial Sequence
  Description of Artificial Sequence: Synthetic single chain variable fragment sequence
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 5567 - protein, 243 aa, Artificial Sequence
  Description of Artificial Sequence: Synthetic single chain variable fragment sequence
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 5568 - protein, 243 aa, Artificial Sequence
  Description of Artificial Sequence: Synthetic single chain variable fragment sequence
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 5569 - protein, 249 aa, Artificial Sequence
  Description of Artificial Sequence: Synthetic single chain variable fragment sequence
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSSGGGGSGGGGSGGGGSGGGGSDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKR

SEQ ID NO: 5570 - protein, 249 aa, Artificial Sequence
  Description of Artificial Sequence: Synthetic single chain variable fragment sequence
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSS

SEQ ID NO: 5571 - protein, 249 aa, Artificial Sequence; identical to SEQ ID NO: 5570
  Description of Artificial Sequence: Synthetic single chain variable fragment sequence

SEQ ID NO: 5572 - protein, 246 aa, Artificial Sequence
  Description of Artificial Sequence: Synthetic single chain variable fragment sequence
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 5573 - protein, 244 aa, Artificial Sequence
  Description of Artificial Sequence: Synthetic single chain variable fragment sequence
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 5574 - protein, 243 aa, Artificial Sequence; identical to SEQ ID NO: 5529
  Description of Artificial Sequence: Synthetic single chain variable fragment sequence

SEQ ID NO: 5575 - protein, 249 aa, Artificial Sequence
  Description of Artificial Sequence: Synthetic single chain variable fragment sequence
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 5576 - protein, 246 aa, Artificial Sequence
  Description of Artificial Sequence: Synthetic single chain variable fragment sequence
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 5577 - protein, 247 aa, Artificial Sequence
  Description of Artificial Sequence: Synthetic single chain variable fragment sequence
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 5578 - protein, 238 aa, Artificial Sequence; identical to SEQ ID NO: 5531
  Description of Artificial Sequence: Synthetic single chain variable fragment sequence

SEQ ID NO: 5579 - protein, 239 aa, Artificial Sequence; identical to SEQ ID NO: 5532
  Description of Artificial Sequence: Synthetic single chain variable fragment sequence

SEQ ID NO: 5580 - protein, 241 aa, Artificial Sequence; identical to SEQ ID NO: 5533
  Description of Artificial Sequence: Synthetic single chain variable fragment sequence

SEQ ID NO: 5581 - protein, 239 aa, Artificial Sequence
  Description of Artificial Sequence: Synthetic single chain variable fragment sequence
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 5582 - protein, 239 aa, Artificial Sequence
  Description of Artificial Sequence: Synthetic single chain variable fragment sequence
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 5583 - protein, 246 aa, Artificial Sequence
  Description of Artificial Sequence: Synthetic single chain variable fragment sequence
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 5584 - protein, 239 aa, Artificial Sequence; identical to SEQ ID NO: 5535
  Description of Artificial Sequence: Synthetic single chain variable fragment sequence

SEQ ID NO: 5585 - protein, 240 aa, Artificial Sequence; identical to SEQ ID NO: 5536
  Description of Artificial Sequence: Synthetic single chain variable fragment sequence

SEQ ID NO: 5586 - protein, 106 aa, Artificial Sequence
  Description of Artificial Sequence: Synthetic single chain variable fragment sequence
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWG

SEQ ID NO: 5587 - DNA, 717 bp, Artificial Sequence
  Description of Artificial Sequence: Synthetic single chain variable fragment sequence
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 5588 - protein, 243 aa, Artificial Sequence; identical to SEQ ID NO: 5545
  Description of Artificial Sequence: Synthetic single chain variable fragment sequence

SEQ ID NO: 5589 - protein, 244 aa, Artificial Sequence; identical to SEQ ID NO: 5546
  Description of Artificial Sequence: Synthetic single chain variable fragment sequence

SEQ ID NO: 5590 - protein, 246 aa, Artificial Sequence; identical to SEQ ID NO: 5547
  Description of Artificial Sequence: Synthetic single chain variable fragment sequence

SEQ ID NO: 5591 - protein, 240 aa, Artificial Sequence; identical to SEQ ID NO: 5548
  Description of Artificial Sequence: Synthetic single chain variable fragment sequence

SEQ ID NO: 5592 - protein, 241 aa, Artificial Sequence; identical to SEQ ID NO: 5549
  Description of Artificial Sequence: Synthetic single chain variable fragment sequence

SEQ ID NO: 5593 - protein, 245 aa, Artificial Sequence; identical to SEQ ID NO: 5550
  Description of Artificial Sequence: Synthetic single chain variable fragment sequence

SEQ ID NO: 5594 - protein, 253 aa, Artificial Sequence; identical to SEQ ID NO: 5551
  Description of Artificial Sequence: Synthetic single chain variable fragment sequence

SEQ ID NO: 5595 - protein, 248 aa, Artificial Sequence; identical to SEQ ID NO: 5552
  Description of Artificial Sequence: Synthetic single chain variable fragment sequence

SEQ ID NO: 5596 - protein, 246 aa, Artificial Sequence
  Description of Artificial Sequence: Synthetic single chain variable fragment sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 5597 - protein, 241 aa, Artificial Sequence; identical to SEQ ID NO: 5538
  Description of Artificial Sequence: Synthetic single chain variable fragment sequence

SEQ ID NO: 5598 - protein, 248 aa, Artificial Sequence; identical to SEQ ID NO: 5539
  Description of Artificial Sequence: Synthetic single chain variable fragment sequence

SEQ ID NO: 5599 - protein, 248 aa, Artificial Sequence; identical to SEQ ID NO: 5540
  Description of Artificial Sequence: Synthetic single chain variable fragment sequence

SEQ ID NO: 5600 - protein, 239 aa, Artificial Sequence; identical to SEQ ID NO: 5556
  Description of Artificial Sequence: Synthetic single chain variable fragment sequence

SEQ ID NO: 5601 - protein, 246 aa, Artificial Sequence; identical to SEQ ID NO: 5557
  Description of Artificial Sequence: Synthetic single chain variable fragment sequence

SEQ ID NO: 5602 - protein, 241 aa, Artificial Sequence; identical to SEQ ID NO: 5542
  Description of Artificial Sequence: Synthetic single chain variable fragment sequence

SEQ ID NO: 5603 - protein, 242 aa, Artificial Sequence; identical to SEQ ID NO: 5559
  Description of Artificial Sequence: Synthetic single chain variable fragment sequence

SEQ ID NO: 5604 - protein, 248 aa, Artificial Sequence; identical to SEQ ID NO: 5543
  Description of Artificial Sequence: Synthetic single chain variable fragment sequence

SEQ ID NO: 5605 - protein, 244 aa, Artificial Sequence; identical to SEQ ID NO: 5561
  Description of Artificial Sequence: Synthetic single chain variable fragment sequence

SEQ ID NO: 5606 - protein, 244 aa, Artificial Sequence; identical to SEQ ID NO: 5562
  Description of Artificial Sequence: Synthetic single chain variable fragment sequence

SEQ ID NO: 5607 - protein, 251 aa, Artificial Sequence; identical to SEQ ID NO: 5563
  Description of Artificial Sequence: Synthetic single chain variable fragment sequence

SEQ ID NO: 5608 - protein, 246 aa, Artificial Sequence; identical to SEQ ID NO: 5564
  Description of Artificial Sequence: Synthetic single chain variable fragment sequence

SEQ ID NO: 5609 - protein, 244 aa, Artificial Sequence; identical to SEQ ID NO: 5565
  Description of Artificial Sequence: Synthetic single chain variable fragment sequence

SEQ ID NO: 5610 - protein, 249 aa, Artificial Sequence; identical to SEQ ID NO: 5566
  Description of Artificial Sequence: Synthetic single chain variable fragment sequence

SEQ ID NO: 5611 - protein, 243 aa, Artificial Sequence; identical to SEQ ID NO: 5567
  Description of Artificial Sequence: Synthetic single chain variable fragment sequence

SEQ ID NO: 5612 - protein, 243 aa, Artificial Sequence; identical to SEQ ID NO: 5568
  Description of Artificial Sequence: Synthetic single chain variable fragment sequence

SEQ ID NO: 5613 - protein, 246 aa, Artificial Sequence; identical to SEQ ID NO: 5572
  Description of Artificial Sequence: Synthetic single chain variable fragment sequence

SEQ ID NO: 5614 - protein, 244 aa, Artificial Sequence; identical to SEQ ID NO: 5573
  Description of Artificial Sequence: Synthetic single chain variable fragment sequence

SEQ ID NO: 5615 - protein, 243 aa, Artificial Sequence; identical to SEQ ID NO: 5529
  Description of Artificial Sequence: Synthetic single chain variable fragment sequence

SEQ ID NO: 5616 - protein, 249 aa, Artificial Sequence; identical to SEQ ID NO: 5575
  Description of Artificial Sequence: Synthetic single chain variable fragment sequence

SEQ ID NO: 5617 - protein, 246 aa, Artificial Sequence; identical to SEQ ID NO: 5576
  Description of Artificial Sequence: Synthetic single chain variable fragment sequence

SEQ ID NO: 5618 - protein, 247 aa, Artificial Sequence; identical to SEQ ID NO: 5577
  Description of Artificial Sequence: Synthetic single chain variable fragment sequence

SEQ ID NO: 5619 - protein, 238 aa, Artificial Sequence; identical to SEQ ID NO: 5531
  Description of Artificial Sequence: Synthetic single chain variable fragment sequence

SEQ ID NO: 5620 - protein, 239 aa, Artificial Sequence; identical to SEQ ID NO: 5532
  Description of Artificial Sequence: Synthetic single chain variable fragment sequence

SEQ ID NO: 5621 - protein, 241 aa, Artificial Sequence; identical to SEQ ID NO: 5533
  Description of Artificial Sequence: Synthetic single chain variable fragment sequence

SEQ ID NO: 5622 - protein, 239 aa, Artificial Sequence; identical to SEQ ID NO: 5581
  Description of Artificial Sequence: Synthetic single chain variable fragment sequence

SEQ ID NO: 5623 - protein, 239 aa, Artificial Sequence; identical to SEQ ID NO: 5582
  Description of Artificial Sequence: Synthetic single chain variable fragment sequence

SEQ ID NO: 5624 - protein, 246 aa, Artificial Sequence; identical to SEQ ID NO: 5583
  Description of Artificial Sequence: Synthetic single chain variable fragment sequence

SEQ ID NO: 5625 - protein, 239 aa, Artificial Sequence; identical to SEQ ID NO: 5535
  Description of Artificial Sequence: Synthetic single chain variable fragment sequence

SEQ ID NO: 5626 - protein, 240 aa, Artificial Sequence; identical to SEQ ID NO: 5536
  Description of Artificial Sequence: Synthetic single chain variable fragment sequence

SEQ ID NO: 5627 - protein, 106 aa, Artificial Sequence; identical to SEQ ID NO: 5586
  Description of Artificial Sequence: Synthetic single chain variable fragment sequence

SEQ ID NO: 5628 - protein, 246 aa, Artificial Sequence; identical to SEQ ID NO: 5572
  Description of Artificial Sequence: Synthetic single chain variable fragment sequence

SEQ ID NO: 5629 - protein, 244 aa, Artificial Sequence; identical to SEQ ID NO: 5573
  Description of Artificial Sequence: Synthetic single chain variable fragment sequence

SEQ ID NO: 5630 - protein, 243 aa, Artificial Sequence; identical to SEQ ID NO: 5529
  Description of Artificial Sequence: Synthetic single chain variable fragment sequence

SEQ ID NO: 5631 - protein, 249 aa, Artificial Sequence; identical to SEQ ID NO: 5575
  Description of Artificial Sequence: Synthetic single chain variable fragment sequence

SEQ ID NO: 5632 - protein, 246 aa, Artificial Sequence; identical to SEQ ID NO: 5576
  Description of Artificial Sequence: Synthetic single chain variable fragment sequence

SEQ ID NO: 5633 - protein, 247 aa, Artificial Sequence; identical to SEQ ID NO: 5577
  Description of Artificial Sequence: Synthetic single chain variable fragment sequence

SEQ ID NO: 5634 - protein, 238 aa, Artificial Sequence; identical to SEQ ID NO: 5531
  Description of Artificial Sequence: Synthetic single chain variable fragment sequence

SEQ ID NO: 5635 - protein, 239 aa, Artificial Sequence; identical to SEQ ID NO: 5532
  Description of Artificial Sequence: Synthetic single chain variable fragment sequence

SEQ ID NO: 5636 - protein, 241 aa, Artificial Sequence; identical to SEQ ID NO: 5533
  Description of Artificial Sequence: Synthetic single chain variable fragment sequence

SEQ ID NO: 5637 - protein, 239 aa, Artificial Sequence; identical to SEQ ID NO: 5581
  Description of Artificial Sequence: Synthetic single chain variable fragment sequence

SEQ ID NO: 5638 - protein, 239 aa, Artificial Sequence; identical to SEQ ID NO: 5582
  Description of Artificial Sequence: Synthetic single chain variable fragment sequence

SEQ ID NO: 5639 - protein, 246 aa, Artificial Sequence; identical to SEQ ID NO: 5583
  Description of Artificial Sequence: Synthetic single chain variable fragment sequence

SEQ ID NO: 5640 - protein, 239 aa, Artificial Sequence; identical to SEQ ID NO: 5535
  Description of Artificial Sequence: Synthetic single chain variable fragment sequence

SEQ ID NO: 5641 - protein, 240 aa, Artificial Sequence; identical to SEQ ID NO: 5536
  Description of Artificial Sequence: Synthetic single chain variable fragment sequence

SEQ ID NO: 5642 - protein, 241 aa, Artificial Sequence; identical to SEQ ID NO: 5537
  Description of Artificial Sequence: Synthetic single chain variable fragment sequence

SEQ ID NO: 5643 - protein, 243 aa, Artificial Sequence; identical to SEQ ID NO: 5545
  Description of Artificial Sequence: Synthetic single chain variable fragment sequence

SEQ ID NO: 5644 - protein, 244 aa, Artificial Sequence; identical to SEQ ID NO: 5546
  Description of Artificial Sequence: Synthetic single chain variable fragment sequence

SEQ ID NO: 5645 - protein, 246 aa, Artificial Sequence; identical to SEQ ID NO: 5547
  Description of Artificial Sequence: Synthetic single chain variable fragment sequence

SEQ ID NO: 5646 - protein, 240 aa, Artificial Sequence; identical to SEQ ID NO: 5548
  Description of Artificial Sequence: Synthetic single chain variable fragment sequence

SEQ ID NO: 5647 - protein, 241 aa, Artificial Sequence; identical to SEQ ID NO: 5549
  Description of Artificial Sequence: Synthetic single chain variable fragment sequence

SEQ ID NO: 5648 - protein, 245 aa, Artificial Sequence; identical to SEQ ID NO: 5550
  Description of Artificial Sequence: Synthetic single chain variable fragment sequence

SEQ ID NO: 5649 - protein, 253 aa, Artificial Sequence; identical to SEQ ID NO: 5551
  Description of Artificial Sequence: Synthetic single chain variable fragment sequence

SEQ ID NO: 5650 - protein, 248 aa, Artificial Sequence; identical to SEQ ID NO: 5552
  Description of Artificial Sequence: Synthetic single chain variable fragment sequence

SEQ ID NO: 5651 - protein, 246 aa, Artificial Sequence; identical to SEQ ID NO: 5596
  Description of Artificial Sequence: Synthetic single chain variable fragment sequence

SEQ ID NO: 5652 - protein, 241 aa, Artificial Sequence; identical to SEQ ID NO: 5538
  Description of Artificial Sequence: Synthetic single chain variable fragment sequence

SEQ ID NO: 5653 - protein, 248 aa, Artificial Sequence
  Description of Artificial Sequence: Synthetic single chain variable fragment sequence
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEFEDSAVYYCQQYHSSPSWTFGQGTRLEIK

SEQ ID NO: 5654 - protein, 248 aa, Artificial Sequence
  Description of Artificial Sequence: Synthetic single chain variable fragment sequence
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEFEDFAVYYCQQYHSSPSWTFGQGTKVEIK

SEQ ID NO: 5655 - protein, 239 aa, Artificial Sequence; identical to SEQ ID NO: 5556
  Description of Artificial Sequence: Synthetic single chain variable fragment sequence

SEQ ID NO: 5656 - protein, 246 aa, Artificial Sequence; identical to SEQ ID NO: 5557
  Description of Artificial Sequence: Synthetic single chain variable fragment sequence

SEQ ID NO: 5657 - protein, 241 aa, Artificial Sequence; identical to SEQ ID NO: 5542
  Description of Artificial Sequence: Synthetic single chain variable fragment sequence

SEQ ID NO: 5658 - protein, 242 aa, Artificial Sequence; identical to SEQ ID NO: 5559
  Description of Artificial Sequence: Synthetic single chain variable fragment sequence

SEQ ID NO: 5659 - protein, 248 aa, Artificial Sequence; identical to SEQ ID NO: 5543
  Description of Artificial Sequence: Synthetic single chain variable fragment sequence

SEQ ID NO: 5660 - protein, 244 aa, Artificial Sequence; identical to SEQ ID NO: 5561
  Description of Artificial Sequence: Synthetic single chain variable fragment sequence

SEQ ID NO: 5661 - protein, 244 aa, Artificial Sequence; identical to SEQ ID NO: 5562
  Description of Artificial Sequence: Synthetic single chain variable fragment sequence

SEQ ID NO: 5662 - protein, 251 aa, Artificial Sequence; identical to SEQ ID NO: 5563
  Description of Artificial Sequence: Synthetic single chain variable fragment sequence

SEQ ID NO: 5663 - protein, 246 aa, Artificial Sequence; identical to SEQ ID NO: 5564
  Description of Artificial Sequence: Synthetic single chain variable fragment sequence

SEQ ID NO: 5664 - protein, 249 aa, Artificial Sequence; identical to SEQ ID NO: 5570
  Description of Artificial Sequence: Synthetic single chain variable fragment sequence

SEQ ID NO: 5665 - protein, 235 aa, Artificial Sequence
  Description of Artificial Sequence: Synthetic single chain variable fragment sequence
DIELTQSPSSLAVSAGEKVTMSCKSSQSILYSSNQKNYLAWYQQKPGQSPKLLIYWASTRESGVPDRFTGSGSGTDFTLTISSVQAEDLAVYYCHQYLSSYTFGGGTKLEIKGGGGSQVQLQQSGPELVRPGASVRISCKASGYTFASYYIQWMKQRPGQGLEWIGWINPGNVNTKYNEKFKGKATLTADKSSTTAYMQLSSLTSEDSAVYFCARSTYYRPLDYWGQGTTVTVSS

SEQ ID NO: 5666 - protein, 245 aa, Artificial Sequence
  Description of Artificial Sequence: Synthetic single chain variable fragment sequence
DIELTQSPSSLAVSAGEKVTMSCKSSQSILYSSNQKNYLAWYQQKPGQSPKLLIYWASTRESGVPDRFTGSGSGTDFTLTISSVQAEDLAVYYCHQYLSSYTFGGGTKLEIKGGGGSGGGGSGGGGSQVQLQQSGPELVRPGASVRISCKASGYTFASYYIQWMKQRPGQGLEWIGWINPGNVNTKYNEKFKGKATLTADKSSTTAYMQLSSLTSEDSAVYFCARSTYYRPLDYWGQGTTVTVSS

SEQ ID NO: 5667 - protein, 264 aa, Artificial Sequence
  Description of Artificial Sequence: Synthetic single chain variable fragment sequence
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 5668 - protein, 264 aa, Artificial Sequence
  Description of Artificial Sequence: Synthetic single chain variable fragment sequence
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 5669 - protein, 264 aa, Artificial Sequence
  Description of Artificial Sequence: Synthetic single chain variable fragment sequence
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 5670 - protein, 266 aa, Artificial Sequence
  Description of Artificial Sequence: Synthetic single chain variable fragment sequence
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 5671 - protein, 263 aa, Artificial Sequence
  Description of Artificial Sequence: Synthetic single chain variable fragment sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 5672 - protein, 263 aa, Artificial Sequence
  Description of Artificial Sequence: Synthetic single chain variable fragment sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 5673 - protein, 263 aa, Artificial Sequence
  Description of Artificial Sequence: Synthetic single chain variable fragment sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 5674 - protein, 263 aa, Artificial Sequence
  Description of Artificial Sequence: Synthetic single chain variable fragment sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 5675 - protein, 263 aa, Artificial Sequence
  Description of Artificial Sequence: Synthetic single chain variable fragment sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 5676 - protein, 263 aa, Artificial Sequence
  Description of Artificial Sequence: Synthetic single chain variable fragment sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 5677 - protein, 263 aa, Artificial Sequence
  Description of Artificial Sequence: Synthetic single chain variable fragment sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 5678 - protein, 263 aa, Artificial Sequence
  Description of Artificial Sequence: Synthetic single chain variable fragment sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 5679 - protein, 263 aa, Artificial Sequence
  Description of Artificial Sequence: Synthetic single chain variable fragment sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 5680 - protein, 263 aa, Artificial Sequence
  Description of Artificial Sequence: Synthetic single chain variable fragment sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 5681 - protein, 263 aa, Artificial Sequence
  Description of Artificial Sequence: Synthetic single chain variable fragment sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 5682 - protein, 263 aa, Artificial Sequence
  Description of Artificial Sequence: Synthetic single chain variable fragment sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 5683 - protein, 263 aa, Artificial Sequence
  Description of Artificial Sequence: Synthetic single chain variable fragment sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 5684 - protein, 263 aa, Artificial Sequence
  Description of Artificial Sequence: Synthetic single chain variable fragment sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 5685 - protein, 263 aa, Artificial Sequence
  Description of Artificial Sequence: Synthetic single chain variable fragment sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 5686 - protein, 263 aa, Artificial Sequence
  Description of Artificial Sequence: Synthetic single chain variable fragment sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 5687 - protein, 263 aa, Artificial Sequence
  Description of Artificial Sequence: Synthetic single chain variable fragment sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 5688 - protein, 263 aa, Artificial Sequence
  Description of Artificial Sequence: Synthetic single chain variable fragment sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 5689 - protein, 263 aa, Artificial Sequence
  Description of Artificial Sequence: Synthetic single chain variable fragment sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 5690 - protein, 263 aa, Artificial Sequence
  Description of Artificial Sequence: Synthetic single chain variable fragment sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 5691 - protein, 263 aa, Artificial Sequence
  Description of Artificial Sequence: Synthetic single chain variable fragment sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 5692 - protein, 263 aa, Artificial Sequence
  Description of Artificial Sequence: Synthetic single chain variable fragment sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 5693 - protein, 263 aa, Artificial Sequence
  Description of Artificial Sequence: Synthetic single chain variable fragment sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 5694 - protein, 263 aa, Artificial Sequence
  Description of Artificial Sequence: Synthetic single chain variable fragment sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 5695 - protein, 263 aa, Artificial Sequence
  Description of Artificial Sequence: Synthetic single chain variable fragment sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 5696 - protein, 263 aa, Artificial Sequence
  Description of Artificial Sequence: Synthetic single chain variable fragment sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 5697 - protein, 263 aa, Artificial Sequence
  Description of Artificial Sequence: Synthetic single chain variable fragment sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 5698 - protein, 263 aa, Artificial Sequence
  Description of Artificial Sequence: Synthetic single chain variable fragment sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 5699 - protein, 263 aa, Artificial Sequence
  Description of Artificial Sequence: Synthetic single chain variable fragment sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 5700 - protein, 263 aa, Artificial Sequence
  Description of Artificial Sequence: Synthetic single chain variable fragment sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 5701 - protein, 263 aa, Artificial Sequence
  Description of Artificial Sequence: Synthetic single chain variable fragment sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 5702 - protein, 263 aa, Artificial Sequence
  Description of Artificial Sequence: Synthetic single chain variable fragment sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 5703 - protein, 282 aa, Artificial Sequence
  Description of Artificial Sequence: Synthetic single chain variable fragment sequence
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRSDPTSS

SEQ ID NO: 5704 - protein, 243 aa, Artificial Sequence
  Description of Artificial Sequence: Synthetic single chain variable fragment sequence
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 5705 - protein, 243 aa, Artificial Sequence
  Description of Artificial Sequence: Synthetic single chain variable fragment sequence
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 5706 - protein, 243 aa, Artificial Sequence
  Description of Artificial Sequence: Synthetic single chain variable fragment sequence
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 5707 - protein, 245 aa, Artificial Sequence
  Description of Artificial Sequence: Synthetic single chain variable fragment sequence
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 5708 - protein, 244 aa, Artificial Sequence
  Description of Artificial Sequence: Synthetic single chain variable fragment sequence
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSSGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 5709 - protein, 282 aa, Artificial Sequence; identical to SEQ ID NO: 5703
  Description of Artificial Sequence: Synthetic single chain variable fragment sequence

SEQ ID NO: 5710 - protein, 237 aa, Artificial Sequence
  Description of Artificial Sequence: Synthetic single chain variable fragment sequence
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSSGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSS

SEQ ID NO: 5711 - protein, 249 aa, Artificial Sequence
  Description of Artificial Sequence: Synthetic single chain variable fragment sequence
DIVLTQSPDSLAVSLGERATINCRASESVDNYGNTFMHWYQQKPGQPPKLLIYRASNLESGVPDRFSGSGSRTDIFITISSLQAEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 5712 - protein, 249 aa, Artificial Sequence
  Description of Artificial Sequence: Synthetic single chain variable fragment sequence
DIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 5713 - protein, 249 aa, Artificial Sequence
  Description of Artificial Sequence: Synthetic single chain variable fragment sequence
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 5714 - protein, 249 aa, Artificial Sequence
  Description of Artificial Sequence: Synthetic single chain variable fragment sequence
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 5715 - protein, 249 aa, Artificial Sequence
  Description of Artificial Sequence: Synthetic single chain variable fragment sequence
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 5716 - protein, 249 aa, Artificial Sequence
  Description of Artificial Sequence: Synthetic single chain variable fragment sequence
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 5717 - protein, 249 aa, Artificial Sequence
  Description of Artificial Sequence: Synthetic single chain variable fragment sequence
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 5718 - protein, 249 aa, Artificial Sequence
  Description of Artificial Sequence: Synthetic single chain variable fragment sequence
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 5719 - protein, 247 aa, Artificial Sequence
  Description of Artificial Sequence: Synthetic single chain variable fragment sequence
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGSTSGSGKPGSSEGSTKGQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSS

SEQ ID NO: 5720 - protein, 263 aa, Artificial Sequence
  Description of Artificial Sequence: Synthetic single chain variable fragment sequence
WSHPQFEKGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 5721 - protein, 247 aa, Artificial Sequence
  Description of Artificial Sequence: Synthetic single chain variable fragment sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGSGSGNWSHPQFEKGSGSGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 5722 - protein, 242 aa, Artificial Sequence
  Description of Artificial Sequence: Synthetic single chain variable fragment sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 5723 - protein, 247 aa, Artificial Sequence
  Description of Artificial Sequence: Synthetic single chain variable fragment sequence
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 5724 - protein, 248 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSSYELTQDPAVSVALGQTVRITCQGDSLRSYYASWYQQKPGQAPVLVIYDKNNRPSGIPDRFSGSSSGNTASLTITGAQAEDEADYYCNSRDSSGNNWVFGGGTKLTVL

SEQ ID NO: 5725 - protein, 242 aa, Artificial Sequence
  Description of Artificial Sequence: Synthetic single chain variable fragment sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 5726 - protein, 242 aa, Artificial Sequence
  Description of Artificial Sequence: Synthetic single chain variable fragment sequence
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 5727 - protein, 242 aa, Artificial Sequence
  Description of Artificial Sequence: Synthetic single chain variable fragment sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 5728 - protein, 246 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCCSYAGRYNSVLFGGGTKLTVL

SEQ ID NO: 5729 - protein, 252 aa, Artificial Sequence
  Description of Artificial Sequence: Synthetic single chain variable fragment sequence
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHIDYGSGSYSPRTSYYYYMSVWGKGTTVTVSSGGGGSGGGGSGGGGSAIQLTQSPSFLSASVGDRVTITCRASQGISSYLNWYQQRAGKAPELLIYAASNLQSGVPSRFSGSGSGTDFTLTITSVQPEDFATYFCQQGDAFPLTFGPGTKVTIR

SEQ ID NO: 5730 - protein, 249 aa, Artificial Sequence
  Description of Artificial Sequence: Synthetic single chain variable fragment sequence
QVQLVQSGGGVVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSEIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLEIK

SEQ ID NO: 5731 - protein, 249 aa, Artificial Sequence
  Description of Artificial Sequence: Synthetic single chain variable fragment sequence
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLDIK

SEQ ID NO: 5732 - protein, 251 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLNRDWVFGGGTKLTVL

SEQ ID NO: 5733 - protein, 252 aa, Artificial Sequence
  Description of Artificial Sequence: Synthetic single chain variable fragment sequence
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 5734 - protein, 252 aa, Artificial Sequence; identical to SEQ ID NO: 5733
  Description of Artificial Sequence: Synthetic single chain variable fragment sequence

SEQ ID NO: 5735 - protein, 252 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLTVL

SEQ ID NO: 5736 - protein, 252 aa, Artificial Sequence; identical to SEQ ID NO: 5735
  Description of Artificial Sequence: Synthetic single chain variable fragment sequence

SEQ ID NO: 5737 - protein, 252 aa, Artificial Sequence; identical to SEQ ID NO: 5735
  Description of Artificial Sequence: Synthetic single chain variable fragment sequence

SEQ ID NO: 5738 - protein, 252 aa, Artificial Sequence
  Description of Artificial Sequence: Synthetic single chain variable fragment sequence
  MOD_RES (76)..(76): Any amino acid
  MOD_RES (201)..(201): Any amino acid
QVQLVESGGGLVQPGRSLRLSCAASGFTFDDYAMHWVRQAPGKGLEWVSGISWNSGRIGYADSVKGRFTISRDNAXNSLFLQMNSLRAEDTAVYYCARDQGYHYYDSAEHAFDIWGQGTVVTVSSGGGGSGGGGSGGGGSQSALTQPASVSGSPGQSITISCTETSSDLGGYNYVSWYQHRPGKAPKLIIYDVTVRPSGVXDRFSGSKSGNTASLTISGLQAEDEADYYCGSYTSSSTLLWVFGGGTKLTVL

SEQ ID NO: 5739 - protein, 252 aa, Artificial Sequence; identical to SEQ ID NO: 5733
  Description of Artificial Sequence: Synthetic single chain variable fragment sequence

SEQ ID NO: 5740 - protein, 250 aa, Artificial Sequence
  Description of Artificial Sequence: Synthetic single chain variable fragment sequence
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLDIK

SEQ ID NO: 5741 - protein, 252 aa, Artificial Sequence
  Description of Artificial Sequence: Synthetic single chain variable fragment sequence
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGQSITISCTGTSSDLGGYNYVSWYQHRPGKAPKLIIYDVTVRPSGVSDRFSGSKSGNTASLTISGLQAEDEADYYCGSYTSSSTLLWVFGGGTKLDIK

SEQ ID NO: 5742 - protein, 236 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSQSVLTQPRSLSGSPGQSVTIACTGASTDVGGYNYVSWYQQHPGKAPKLMIYDVNKRPSGVPDRFSGSKSGNTAFLTISGLQAEDEADYYCCSYAGSYTFEVFGGGTKLTVL

SEQ ID NO: 5743 - protein, 251 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQLVLTQPPSVSGSPGQSVTFSCTGASSDVGGYDHVSWYQHHPGKGPKLLIYDVSKRPSGVPDRFSGSKSGNTASLTISGLQAEDEADYYCCSFAGYYTYWLFGGGTKVTVL

SEQ ID NO: 5744 - protein, 246 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCCSYAGRYNSVPFGGGTKLTVL

SEQ ID NO: 5745 - protein, 239 aa, Artificial Sequence
  Description of Artificial Sequence: Synthetic single chain variable fragment sequence
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSSYVLTQPPSASGTPGQRVTISCSGSSSNIGSNTVNWYQQFPGTAPKLLIYSNNQRPSGVPDRFSGSKSGTSASLAISGLQSEDEAEYYCAAWDDSLNVV

SEQ ID NO: 5746 - protein, 250 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEGDYYCGTWDISLRFGVFGGGTKVTVL

SEQ ID NO: 5747 - protein, 251 aa, Artificial Sequence
  Description of Artificial Sequence: Synthetic single chain variable fragment sequence
EVQLVESGGGLVQPGRSLRLSCAASGFTFDDYAMHWVRLAPGKGLEWVSGISWNSGRIGYADSVKGRFTISRDNAKNSLFLQMNSLRAKDTAVYYCARDQGYHYYDSAEHAFDIWGQGTMVTVSSGGGGSGGGGSGGGGSQSVLTQPRSVSGSPGQSVTISCTGPISGVGDYTSVSWYQHYPGKTPKLIIYDVTQRPSGVPNRFSGSKSGNTASLTISGLQADDEADYYCCSYEAPTHTYVFGTGTKLTVL

SEQ ID NO: 5748 - protein, 242 aa, Artificial Sequence
  Description of Artificial Sequence: Synthetic single chain variable fragment sequence
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 5749 - protein, 242 aa, Artificial Sequence
  Description of Artificial Sequence: Synthetic single chain variable fragment sequence
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 5750 - protein, 246 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPRSVSGFPGQSVTISCTGTTSDDVSWYQQHPGKAPQLMLYDVSKRPSGVPHRFSGSRSGRAASLIISGLQTEDEADYFCSSYAGRYNSVLFGGGTKLTVL

SEQ ID NO: 5751 - protein, 249 aa, Artificial Sequence
  Description of Artificial Sequence: Synthetic single chain variable fragment sequence
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSEIVLTQSPATLSLSPGETATLSCRASQSINHYLAWYQQKPGQAPRLLIYDASNRATGIPARFSGSGSGTDFTLTISSLEPEDFATYYCQQSYSHPRMYTFGQGTKLDIK

SEQ ID NO: 5752 - protein, 249 aa, Artificial Sequence
  Description of Artificial Sequence: Synthetic single chain variable fragment sequence
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSSLSASVGDRVTVTCQASQDISNYLNWYQQKPGRAPKLLIYDASNVKAGVPSRFSGGGSGTDFTLTISSLQPEDFATYYCQQSYSTPQAYTFGQGTKLEIK

SEQ ID NO: 5753 - protein, 252 aa, Artificial Sequence; identical to SEQ ID NO: 5735
  Description of Artificial Sequence: Synthetic single chain variable fragment sequence

SEQ ID NO: 5754 - protein, 495 aa, Artificial Sequence
  Description of Artificial Sequence: Synthetic single chain variable fragment sequence
METDTLLLWVLLLWVPGSTGEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5755 - protein, 247 aa, Artificial Sequence
  Description of Artificial Sequence: Synthetic single chain variable fragment sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 5756 - protein, 251 aa, Artificial Sequence
  Description of Artificial Sequence: Synthetic single chain variable fragment sequence
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQAVLTQPRSVSGSPGQSVTISCTGISSGVDSHRYVSWYQHHPGKAPKLMIYDFSKRPSGVPDRFSGSKSGNTASLTISGLQAEDEADYYCSSYAAISPNYVFGTGTKLTVL

SEQ ID NO: 5757 - protein, 250 aa, Artificial Sequence
  Description of Artificial Sequence: Synthetic single chain variable fragment sequence
QVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSALTQPASVSGSPGHSITISCTGTRSDVGGFDYVSWYQHNPGKAPKLIIYDVTKRPSGVSNRFSGAKSGITASLTISGLQAEDEADYYCTSYRPGPTFVFGTGTKLTVL

SEQ ID NO: 5758 - protein, 247 aa, Artificial Sequence
  Description of Artificial Sequence: Synthetic single chain variable fragment sequence
EVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSDIQLTQSPSTLSASVGDRVTITCRASQSISRWLAWYQQKPGKAPKLLIYDASNLETGVPSRFSGSGSGTDFTFTISSLQPEDIATYYCQQYDNLPLTFGGGTKVEIK

SEQ ID NO: 5759 - protein, 248 aa, Artificial Sequence
  Description of Artificial Sequence: Synthetic single chain variable fragment sequence
QMQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCARDQGYHYYDSAEHAFDIWGQGTVVTVSSGGGGSGGGGSGGGGSAIRMTQSPSTLSASVGDRVTITCRASQSISHYLAWYQQKPGKAPKLLIFDASRLASGVPSRFSGSGSGTDFTLTISSLQPEDFATYYCQQSYGAPMFTFGPGTRVDLK

SEQ ID NO: 5760 - protein, 242 aa, Artificial Sequence
  Description of Artificial Sequence: Synthetic single chain variable fragment sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 5761 - protein, 251 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQSALTQPASVSGSPGQSITISCTGTSSDVGAYNFVSWYQQLPGTAPKFLIYDNNKRPPGIPDRFSGSKSGTSATLGITGLQTGDEADYYCATWDSGLSAVVFGGGTKLTVL

SEQ ID NO: 5762 - protein, 247 aa, Artificial Sequence
  Description of Artificial Sequence: Synthetic single chain variable fragment sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 5763 - protein, 250 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQSALTQPASVSGSPGQSITIFCTGTSSDVGGYNYVSWYQQLPGTAPKLLIYSNNQRPSGVPDRFSGSKSGTSASLAISGLRSEDEADYYCAAWDDSLSVVFGGGTKLTVL

SEQ ID NO: 5764 - protein, 252 aa, Artificial Sequence
  Description of Artificial Sequence: Synthetic single chain variable fragment sequence
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 5765 - protein, 247 aa, Artificial Sequence
  Description of Artificial Sequence: Synthetic single chain variable fragment sequence
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 5766 - protein, 247 aa, Artificial Sequence
  Description of Artificial Sequence: Synthetic single chain variable fragment sequence
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 5767 - protein, 249 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTVVTVSSGGGGSGGGGSGGGGSQSVLTQPPSVSAAPGQEVTISCSGSSSNIGNNYVSWYQQLPGTAPKLLIYDNDKRPSGIPDRFSGSKSGTSATLGITGLQTGDEADYYCGTWDGNLSAVFGGGTKVTVL

SEQ ID NO: 5768 - protein, 251 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGRIGYADSVKGRFTISRDNAKNSLFLQMNSLRAEDTAVYYCARDQGYHYYDSAEHAFDIWGQGTMVTVSSGGGGSGGGGSGGGGSQAVLTQPRSVSGSPGQSVTISCTGISSGVDSHRYVSWYQHHPGKAPKLMIYDFSKRPSGVPDRFSGSKSGNTASLTISGLQAEDEADYYCCSYAAISPNYVFGTGTKLTVL

SEQ ID NO: 5769 - protein, 247 aa, Artificial Sequence
  Description of Artificial Sequence: Synthetic single chain variable fragment sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 5770 - protein, 241 aa, Artificial Sequence
  Description of Artificial Sequence: Synthetic single chain variable fragment sequence
QVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKR

SEQ ID NO: 5771 - protein, 248 aa, Artificial Sequence; identical to SEQ ID NO: 5724
  Description of Artificial Sequence: Synthetic single chain variable fragment sequence

SEQ ID NO: 5772 - protein, 246 aa, Artificial Sequence; identical to SEQ ID NO: 5728
  Description of Artificial Sequence: Synthetic single chain variable fragment sequence

SEQ ID NO: 5773 - protein, 252 aa, Artificial Sequence; identical to SEQ ID NO: 5729
  Description of Artificial Sequence: Synthetic single chain variable fragment sequence

SEQ ID NO: 5774 - protein, 249 aa, Artificial Sequence; identical to SEQ ID NO: 5730
  Description of Artificial Sequence: Synthetic single chain variable fragment sequence

SEQ ID NO: 5775 - protein, 249 aa, Artificial Sequence; identical to SEQ ID NO: 5731
  Description of Artificial Sequence: Synthetic single chain variable fragment sequence

SEQ ID NO: 5776 - protein, 251 aa, Artificial Sequence; identical to SEQ ID NO: 5732
  Description of Artificial Sequence: Synthetic single chain variable fragment sequence

SEQ ID NO: 5777 - protein, 252 aa, Artificial Sequence; identical to SEQ ID NO: 5733
  Description of Artificial Sequence: Synthetic single chain variable fragment sequence

SEQ ID NO: 5778 - protein, 252 aa, Artificial Sequence; identical to SEQ ID NO: 5733
  Description of Artificial Sequence: Synthetic single chain variable fragment sequence

SEQ ID NO: 5779 - protein, 249 aa, Artificial Sequence
  Description of Artificial Sequence: Synthetic single chain variable fragment sequence
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid
QVQLVESGGGLVQPGRSLRLSCAASGFTFDDYAMHWVRQAPGKGLEWVSGISWNSGRIGYADSXXGRXXISRDNAKNSLFLQMNSLRAEDTAXYYCAXDQGXHXYDSAEHAFXIWGQGTVVTVSSGGGGSGGGGSGGGGSQSVLXXPXXASGSPGQSVTVSCTGTGRDIGAYDYVSWYQQHPGKAPKLLIYGVNKRPSGVPDRFSGSKSDNTASLTVSGLQVEDEADYYCSSXAGRKYVFGTGXKVTVL

SEQ ID NO: 5780 - protein, 252 aa, Artificial Sequence; identical to SEQ ID NO: 5735
  Description of Artificial Sequence: Synthetic single chain variable fragment sequence

SEQ ID NO: 5781 - protein, 252 aa, Artificial Sequence; identical to SEQ ID NO: 5735
  Description of Artificial Sequence: Synthetic single chain variable fragment sequence

SEQ ID NO: 5782 - protein, 252 aa, Artificial Sequence; identical to SEQ ID NO: 5735
  Description of Artificial Sequence: Synthetic single chain variable fragment sequence

SEQ ID NO: 5783 - protein, 252 aa, Artificial Sequence; identical to SEQ ID NO: 5738
  Description of Artificial Sequence: Synthetic single chain variable fragment sequence
  MOD_RES (76)..(76): Any amino acid
  MOD_RES (201)..(201): Any amino acid

SEQ ID NO: 5784 - protein, 252 aa, Artificial Sequence; identical to SEQ ID NO: 5733
  Description of Artificial Sequence: Synthetic single chain variable fragment sequence

SEQ ID NO: 5785 - protein, 250 aa, Artificial Sequence; identical to SEQ ID NO: 5740
  Description of Artificial Sequence: Synthetic single chain variable fragment sequence

SEQ ID NO: 5786 - protein, 252 aa, Artificial Sequence; identical to SEQ ID NO: 5741
  Description of Artificial Sequence: Synthetic single chain variable fragment sequence

SEQ ID NO: 5787 - protein, 236 aa, Artificial Sequence; identical to SEQ ID NO: 5742
  Description of Artificial Sequence: Synthetic single chain variable fragment sequence

SEQ ID NO: 5788 - protein, 251 aa, Artificial Sequence; identical to SEQ ID NO: 5743
  Description of Artificial Sequence: Synthetic single chain variable fragment sequence

SEQ ID NO: 5789 - protein, 246 aa, Artificial Sequence; identical to SEQ ID NO: 5744
  Description of Artificial Sequence: Synthetic single chain variable fragment sequence

SEQ ID NO: 5790 - protein, 239 aa, Artificial Sequence; identical to SEQ ID NO: 5745
  Description of Artificial Sequence: Synthetic single chain variable fragment sequence

SEQ ID NO: 5791 - protein, 250 aa, Artificial Sequence; identical to SEQ ID NO: 5746
  Description of Artificial Sequence: Synthetic single chain variable fragment sequence

SEQ ID NO: 5792 - protein, 251 aa, Artificial Sequence; identical to SEQ ID NO: 5747
  Description of Artificial Sequence: Synthetic single chain variable fragment sequence

SEQ ID NO: 5793 - protein, 273 aa, Artificial Sequence
  Description of Artificial Sequence: Synthetic single chain variable fragment sequence
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 5794 - protein, 270 aa, Artificial Sequence
  Description of Artificial Sequence: Synthetic single chain variable fragment sequence
MALPVTALLLPLALLLHAARPEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRSDPTSS

SEQ ID NO: 5795 - protein, 277 aa, Artificial Sequence
  Description of Artificial Sequence: Synthetic single chain variable fragment sequence
MAPAMESPTLLCVALLFFAPDGVLAEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSDP

SEQ ID NO: 5796 - protein, 246 aa, Artificial Sequence; identical to SEQ ID NO: 5750
  Description of Artificial Sequence: Synthetic single chain variable fragment sequence

SEQ ID NO: 5797 - protein, 249 aa, Artificial Sequence; identical to SEQ ID NO: 5751
  Description of Artificial Sequence: Synthetic single chain variable fragment sequence

SEQ ID NO: 5798 - protein, 249 aa, Artificial Sequence; identical to SEQ ID NO: 5752
  Description of Artificial Sequence: Synthetic single chain variable fragment sequence

SEQ ID NO: 5799 - protein, 252 aa, Artificial Sequence; identical to SEQ ID NO: 5735
  Description of Artificial Sequence: Synthetic single chain variable fragment sequence

SEQ ID NO: 5800 - protein, 251 aa, Artificial Sequence; identical to SEQ ID NO: 5756
  Description of Artificial Sequence: Synthetic single chain variable fragment sequence

SEQ ID NO: 5801 - protein, 250 aa, Artificial Sequence; identical to SEQ ID NO: 5757
  Description of Artificial Sequence: Synthetic single chain variable fragment sequence

SEQ ID NO: 5802 - protein, 247 aa, Artificial Sequence; identical to SEQ ID NO: 5758
  Description of Artificial Sequence: Synthetic single chain variable fragment sequence

SEQ ID NO: 5803 - protein, 248 aa, Artificial Sequence; identical to SEQ ID NO: 5759
  Description of Artificial Sequence: Synthetic single chain variable fragment sequence

SEQ ID NO: 5804 - protein, 251 aa, Artificial Sequence; identical to SEQ ID NO: 5761
  Description of Artificial Sequence: Synthetic single chain variable fragment sequence

SEQ ID NO: 5805 - protein, 250 aa, Artificial Sequence; identical to SEQ ID NO: 5763
  Description of Artificial Sequence: Synthetic single chain variable fragment sequence

SEQ ID NO: 5806 - protein, 249 aa, Artificial Sequence; identical to SEQ ID NO: 5767
  Description of Artificial Sequence: Synthetic single chain variable fragment sequence

SEQ ID NO: 5807 - protein, 251 aa, Artificial Sequence; identical to SEQ ID NO: 5768
  Description of Artificial Sequence: Synthetic single chain variable fragment sequence

SEQ ID NO: 5808 - protein, 249 aa, Artificial Sequence; identical to SEQ ID NO: 5731
  Description of Artificial Sequence: Synthetic single chain variable fragment sequence

SEQ ID NO: 5809 - protein, 242 aa, Artificial Sequence; identical to SEQ ID NO: 5722
  Description of Artificial Sequence: Synthetic single chain variable fragment sequence

SEQ ID NO: 5810 - protein, 245 aa, Artificial Sequence
  Description of Artificial Sequence: Synthetic single chain variable fragment sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 5811 - protein, 119 aa, Artificial Sequence
  Description of Artificial Sequence: Synthetic single chain variable fragment sequence
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 5812 - protein, 438 aa, Artificial Sequence
  Description of Artificial Sequence: Synthetic single chain variable fragment sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5813 - protein, 272 aa, Artificial Sequence
  Description of Artificial Sequence: Synthetic single chain variable fragment sequence
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRSD

SEQ ID NO: 5814 - protein, 267 aa, Artificial Sequence
  Description of Artificial Sequence: Synthetic single chain variable fragment sequence
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRSDP

SEQ ID NO: 5815 - protein, 270 aa, Artificial Sequence; identical to SEQ ID NO: 5794
  Description of Artificial Sequence: Synthetic single chain variable fragment sequence

SEQ ID NO: 5816 - protein, 277 aa, Artificial Sequence; identical to SEQ ID NO: 5795
  Description of Artificial Sequence: Synthetic single chain variable fragment sequence

SEQ ID NO: 5817 - protein, 242 aa, Artificial Sequence; identical to SEQ ID NO: 5727
  Description of Artificial Sequence: Synthetic single chain variable fragment sequence

SEQ ID NO: 5818 - protein, 242 aa, Artificial Sequence; identical to SEQ ID NO: 5748
  Description of Artificial Sequence: Synthetic single chain variable fragment sequence

SEQ ID NO: 5819 - protein, 242 aa, Artificial Sequence; identical to SEQ ID NO: 5749
  Description of Artificial Sequence: Synthetic single chain variable fragment sequence

SEQ ID NO: 5820 - protein, 247 aa, Artificial Sequence; identical to SEQ ID NO: 5755
  Description of Artificial Sequence: Synthetic single chain variable fragment sequence

SEQ ID NO: 5821 - protein, 247 aa, Artificial Sequence; identical to SEQ ID NO: 5762
  Description of Artificial Sequence: Synthetic single chain variable fragment sequence

SEQ ID NO: 5822 - protein, 247 aa, Artificial Sequence; identical to SEQ ID NO: 5765
  Description of Artificial Sequence: Synthetic single chain variable fragment sequence

SEQ ID NO: 5823 - protein, 247 aa, Artificial Sequence; identical to SEQ ID NO: 5766
  Description of Artificial Sequence: Synthetic single chain variable fragment sequence

SEQ ID NO: 5824 - protein, 247 aa, Artificial Sequence; identical to SEQ ID NO: 5769
  Description of Artificial Sequence: Synthetic single chain variable fragment sequence

SEQ ID NO: 5825 - protein, 247 aa, Artificial Sequence; identical to SEQ ID NO: 5723
  Description of Artificial Sequence: Synthetic single chain variable fragment sequence

SEQ ID NO: 5826 - protein, 242 aa, Artificial Sequence; identical to SEQ ID NO: 5725
  Description of Artificial Sequence: Synthetic single chain variable fragment sequence

SEQ ID NO: 5827 - protein, 495 aa, Artificial Sequence; identical to SEQ ID NO: 5754
  Description of Artificial Sequence: Synthetic single chain variable fragment sequence

SEQ ID NO: 5828 - protein, 242 aa, Artificial Sequence; identical to SEQ ID NO: 5726
  Description of Artificial Sequence: Synthetic single chain variable fragment sequence

SEQ ID NO: 5829 - protein, 242 aa, Artificial Sequence; identical to SEQ ID NO: 5760
  Description of Artificial Sequence: Synthetic single chain variable fragment sequence

SEQ ID NO: 5830 - protein, 252 aa, Artificial Sequence; identical to SEQ ID NO: 5764
  Description of Artificial Sequence: Synthetic single chain variable fragment sequence

SEQ ID NO: 5831 - protein, 250 aa, Artificial Sequence
  Description of Artificial Sequence: Synthetic single chain variable fragment sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSD

SEQ ID NO: 5832 - protein, 242 aa, Artificial Sequence; identical to SEQ ID NO: 5760
  Description of Artificial Sequence: Synthetic single chain variable fragment sequence

SEQ ID NO: 5833 - protein, 251 aa, Artificial Sequence
  Description of Artificial Sequence: Synthetic single chain variable fragment sequence
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRAD

SEQ ID NO: 5834 - protein, 271 aa, Artificial Sequence
  Description of Artificial Sequence: Synthetic single chain variable fragment sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 5835 - protein, 248 aa, Artificial Sequence; identical to SEQ ID NO: 5724
  Description of Artificial Sequence: Synthetic single chain variable fragment sequence

SEQ ID NO: 5836 - protein, 246 aa, Artificial Sequence; identical to SEQ ID NO: 5728
  Description of Artificial Sequence: Synthetic single chain variable fragment sequence

SEQ ID NO: 5837 - protein, 252 aa, Artificial Sequence; identical to SEQ ID NO: 5729
  Description of Artificial Sequence: Synthetic single chain variable fragment sequence

SEQ ID NO: 5838 - protein, 249 aa, Artificial Sequence; identical to SEQ ID NO: 5730
  Description of Artificial Sequence: Synthetic single chain variable fragment sequence

SEQ ID NO: 5839 - protein, 251 aa, Artificial Sequence; identical to SEQ ID NO: 5732
  Description of Artificial Sequence: Synthetic single chain variable fragment sequence

SEQ ID NO: 5840 - protein, 252 aa, Artificial Sequence; identical to SEQ ID NO: 5733
  Description of Artificial Sequence: Synthetic single chain variable fragment sequence

SEQ ID NO: 5841 - protein, 249 aa, Artificial Sequence; identical to SEQ ID NO: 5779
  Description of Artificial Sequence: Synthetic single chain variable fragment sequence
  MOD_RES (64)..(65): Any amino acid
  MOD_RES (68)..(69): Any amino acid
  MOD_RES (93)..(93): Any amino acid
  MOD_RES (98)..(98): Any amino acid
  MOD_RES (102)..(102): Any amino acid
  MOD_RES (104)..(104): Any amino acid
  MOD_RES (113)..(113): Any amino acid
  MOD_RES (145)..(146): Any amino acid
  MOD_RES (148)..(149): Any amino acid
  MOD_RES (233)..(233): Any amino acid
  MOD_RES (244)..(244): Any amino acid

SEQ ID NO: 5842 - protein, 252 aa, Artificial Sequence; identical to SEQ ID NO: 5738
  Description of Artificial Sequence: Synthetic single chain variable fragment sequence
  MOD_RES (76)..(76): Any amino acid
  MOD_RES (201)..(201): Any amino acid

SEQ ID NO: 5843 - protein, 250 aa, Artificial Sequence; identical to SEQ ID NO: 5740
  Description of Artificial Sequence: Synthetic single chain variable fragment sequence

SEQ ID NO: 5844 - protein, 252 aa, Artificial Sequence; identical to SEQ ID NO: 5741
  Description of Artificial Sequence: Synthetic single chain variable fragment sequence

SEQ ID NO: 5845 - protein, 236 aa, Artificial Sequence; identical to SEQ ID NO: 5742
  Description of Artificial Sequence: Synthetic single chain variable fragment sequence

SEQ ID NO: 5846 - protein, 251 aa, Artificial Sequence; identical to SEQ ID NO: 5743
  Description of Artificial Sequence: Synthetic single chain variable fragment sequence

SEQ ID NO: 5847 - protein, 246 aa, Artificial Sequence; identical to SEQ ID NO: 5744
  Description of Artificial Sequence: Synthetic single chain variable fragment sequence

SEQ ID NO: 5848 - protein, 239 aa, Artificial Sequence; identical to SEQ ID NO: 5745
  Description of Artificial Sequence: Synthetic single chain variable fragment sequence

SEQ ID NO: 5849 - protein, 250 aa, Artificial Sequence; identical to SEQ ID NO: 5746
  Description of Artificial Sequence: Synthetic single chain variable fragment sequence

SEQ ID NO: 5850 - protein, 251 aa, Artificial Sequence; identical to SEQ ID NO: 5747
  Description of Artificial Sequence: Synthetic single chain variable fragment sequence

SEQ ID NO: 5851 - protein, 246 aa, Artificial Sequence; identical to SEQ ID NO: 5750
  Description of Artificial Sequence: Synthetic single chain variable fragment sequence

SEQ ID NO: 5852 - protein, 249 aa, Artificial Sequence; identical to SEQ ID NO: 5751
  Description of Artificial Sequence: Synthetic single chain variable fragment sequence

SEQ ID NO: 5853 - protein, 249 aa, Artificial Sequence; identical to SEQ ID NO: 5752
  Description of Artificial Sequence: Synthetic single chain variable fragment sequence

SEQ ID NO: 5854 - protein, 252 aa, Artificial Sequence; identical to SEQ ID NO: 5735
  Description of Artificial Sequence: Synthetic single chain variable fragment sequence

SEQ ID NO: 5855 - protein, 251 aa, Artificial Sequence; identical to SEQ ID NO: 5756
  Description of Artificial Sequence: Synthetic single chain variable fragment sequence

SEQ ID NO: 5856 - protein, 250 aa, Artificial Sequence; identical to SEQ ID NO: 5757
  Description of Artificial Sequence: Synthetic single chain variable fragment sequence

SEQ ID NO: 5857 - protein, 247 aa, Artificial Sequence; identical to SEQ ID NO: 5758
  Description of Artificial Sequence: Synthetic single chain variable fragment sequence

SEQ ID NO: 5858 - protein, 248 aa, Artificial Sequence; identical to SEQ ID NO: 5759
  Description of Artificial Sequence: Synthetic single chain variable fragment sequence

SEQ ID NO: 5859 - protein, 251 aa, Artificial Sequence; identical to SEQ ID NO: 5761
  Description of Artificial Sequence: Synthetic single chain variable fragment sequence

SEQ ID NO: 5860 - protein, 250 aa, Artificial Sequence; identical to SEQ ID NO: 5763
  Description of Artificial Sequence: Synthetic single chain variable fragment sequence

SEQ ID NO: 5861 - protein, 249 aa, Artificial Sequence; identical to SEQ ID NO: 5767
  Description of Artificial Sequence: Synthetic single chain variable fragment sequence

SEQ ID NO: 5862 - protein, 251 aa, Artificial Sequence; identical to SEQ ID NO: 5768
  Description of Artificial Sequence: Synthetic single chain variable fragment sequence

SEQ ID NO: 5863 - protein, 249 aa, Artificial Sequence; identical to SEQ ID NO: 5731
  Description of Artificial Sequence: Synthetic single chain variable fragment sequence

SEQ ID NO: 5864 - protein, 277 aa, Artificial Sequence
  Description of Artificial Sequence: Synthetic single chain variable fragment sequence
MAPAMESPTLLCVALLFFAPDGVLAEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYVGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYVCMQHLEYPFTFGAGTKLELKRSDP

SEQ ID NO: 5865 - protein, 514 aa, Artificial Sequence
  Description of Artificial Sequence: Synthetic single chain variable fragment sequence
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 5866 - protein, 514 aa, Artificial Sequence
  Description of Artificial Sequence: Synthetic single chain variable fragment sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLT

SEQ ID NO: 5867 - protein, 251 aa, Artificial Sequence
  Description of Artificial Sequence: Synthetic single chain variable fragment sequence
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTVSSGGGGSGGGGSGGGGSGGGGSDIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 5868 - protein, 251 aa, Artificial Sequence
  Description of Artificial Sequence: Synthetic single chain variable fragment sequence
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 5869 - protein, 251 aa, Artificial Sequence
  Description of Artificial Sequence: Synthetic single chain variable fragment sequence
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 5870 - protein, 251 aa, Artificial Sequence
  Description of Artificial Sequence: Synthetic single chain variable fragment sequence
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 5871 - protein, 251 aa, Artificial Sequence
  Description of Artificial Sequence: Synthetic single chain variable fragment sequence
QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 5872 - protein, 251 aa, Artificial Sequence
  Description of Artificial Sequence: Synthetic single chain variable fragment sequence
QVQLVQSGAEVKKPGASVKVSCKASGFTFRDYYMAWVRQAPGQGLEWMGSISYEGNPYYGDSVKGRVTMTRDNSTSTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 5873 - protein, 111 aa, Artificial Sequence
  Description of Artificial Sequence: Synthetic single chain variable fragment sequence
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 5874 - protein, 245 aa, Artificial Sequence
  Description of Artificial Sequence: Synthetic single chain variable fragment sequence
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 5875 - protein, 245 aa, Artificial Sequence
  Description of Artificial Sequence: Synthetic single chain variable fragment sequence
EVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKA

SEQ ID NO: 5876 - protein, 236 aa, Artificial Sequence
  Description of Artificial Sequence: Synthetic single chain variable fragment sequence
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIK

SEQ ID NO: 5877 - protein, 254 aa, Artificial Sequence
  Description of Artificial Sequence: Synthetic single chain variable fragment sequence
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 5878 - protein, 251 aa, Artificial Sequence
  Description of Artificial Sequence: Synthetic single chain variable fragment sequence
EVQLQQSGPGLVKPSQTLSLTCAISGDSVSNNNAAWNWIRQSPSRGLEWLGRTYHRSTWYNDYVGSVKSRITINPDTSKNQFSLQLNSVTPEDTAVYYCARETDYGDYGAFDIWGQGTTVTVSSGGGGSGGGGSGGGGSQSALTQPASVSGSPGQSITISCTGSRNDIGAYESVSWYQQHPGNAPKLIIHGVNNRPSGVFDRFSVSQSGNTASLTISGLQAEDEADYYCSSHTTTSTLYVFGTGTKVTVLG

SEQ ID NO: 5879 - protein, 247 aa, Artificial Sequence
  Description of Artificial Sequence: Synthetic single chain variable fragment sequence
EVQLQQSGPGLVNPSQTLSITCAISGDSVSSNSAAWNWIRQSPSRGLEWLGRTFYRSKWYNDYAVSVKGRITISPDTSKNQFSLQLNSVTPEDTAVYYCAGGDYYYGLDVWGQGTTVTVSSGGGGSGGGGSGGGGSQSALTQPASVSGSPGQSITISCTGSSSDVGGYNSVSWYQQHPGKAPKLMIYEVINRPSGVSHRFSGSKSGNTASLTISGLQAEDEADYYCSSYTSSSTYVFGTGTKVTVLG

SEQ ID NO: 5880 - protein, 254 aa, Artificial Sequence
  Description of Artificial Sequence: Synthetic single chain variable fragment sequence
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGSSSDIGGFNYVSWYQQHAGEAPKLMIYEVTNRPSGVSDRFSGSKSDNTASLTISGLQAEDEADYYCSSYASGSPLYVFGTGTKVTVLG

SEQ ID NO: 5881 - protein, 254 aa, Artificial Sequence
  Description of Artificial Sequence: Synthetic single chain variable fragment sequence
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITFSCTGTSSDIGGYNYVSWYQQHPGKAPKLMIYEVSNRPSGVSNRFSGTKSGNTASLTISGLQAEDEADYYCSSYTSSSTLYVFGTGTKLTVLG

SEQ ID NO: 5882 - protein, 254 aa, Artificial Sequence
  Description of Artificial Sequence: Synthetic single chain variable fragment sequence
QVQLQESGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVLG

SEQ ID NO: 5883 - protein, 254 aa, Artificial Sequence
  Description of Artificial Sequence: Synthetic single chain variable fragment sequence
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLG

SEQ ID NO: 5884 - protein, 254 aa, Artificial Sequence
  Description of Artificial Sequence: Synthetic single chain variable fragment sequence
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYIFGTGTKVTVLG

SEQ ID NO: 5885 - protein, 253 aa, Artificial Sequence
  Description of Artificial Sequence: Synthetic single chain variable fragment sequence
EVQLQQSGPGLVKPSQTLPLTCAISGDSVLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 5886 - protein, 253 aa, Artificial Sequence
  Description of Artificial Sequence: Synthetic single chain variable fragment sequence
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 5887 - protein, 251 aa, Artificial Sequence
  Description of Artificial Sequence: Synthetic single chain variable fragment sequence
QVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVL

SEQ ID NO: 5888 - protein, 251 aa, Artificial Sequence
  Description of Artificial Sequence: Synthetic single chain variable fragment sequence
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVL

SEQ ID NO: 5889 - protein, 253 aa, Artificial Sequence
  Description of Artificial Sequence: Synthetic single chain variable fragment sequence
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVL

SEQ ID NO: 5890 - protein, 246 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVL

SEQ ID NO: 5891 - protein, 245 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVL

SEQ ID NO: 5892 - protein, 247 aa, Artificial Sequence
  Description of Artificial Sequence: Synthetic single chain variable fragment sequence
EVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 5893 - protein, 247 aa, Artificial Sequence
  Description of Artificial Sequence: Synthetic single chain variable fragment sequence
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTVSSGGGGSGGGGSGGGGSQSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVL

SEQ ID NO: 5894 - protein, 254 aa, Artificial Sequence
  Description of Artificial Sequence: Synthetic single chain variable fragment sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTVSSGGGGSGGGGSGGGGSNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVL

SEQ ID NO: 5895 - protein, 241 aa, Artificial Sequence
  Description of Artificial Sequence: Synthetic single chain variable fragment sequence
EVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVL

SEQ ID NO: 5896 - protein, 254 aa, Artificial Sequence
  Description of Artificial Sequence: Synthetic single chain variable fragment sequence
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVL

SEQ ID NO: 5897 - protein, 249 aa, Artificial Sequence
  Description of Artificial Sequence: Synthetic single chain variable fragment sequence
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTVSSGGGGSGGGGSGGGGSSSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVL

SEQ ID NO: 5898 - protein, 253 aa, Artificial Sequence
  Description of Artificial Sequence: Synthetic single chain variable fragment sequence
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 5899 - protein, 245 aa, Artificial Sequence
  Description of Artificial Sequence: Synthetic single chain variable fragment sequence
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTVSSGDGGSGGGGSGGGGSNFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVL

SEQ ID NO: 5900 - protein, 242 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTVSSGGGGSGGGGSGGGGSQSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVL

SEQ ID NO: 5901 - protein, 247 aa, Artificial Sequence
  Description of Artificial Sequence: Synthetic single chain variable fragment sequence
EVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTVSSGGGGSGGGGSGGGGSSSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVL

SEQ ID NO: 5902 - protein, 243 aa, Artificial Sequence
  Description of Artificial Sequence: Synthetic single chain variable fragment sequence
EVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 5903 - protein, 250 aa, Artificial Sequence
  Description of Artificial Sequence: Synthetic single chain variable fragment sequence
QVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTVSSGGGGSGGGGSGGGGSDVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKR

SEQ ID NO: 5904 - protein, 245 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTVSSGGGGSGGGGSGGGGSQSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 5905 - protein, 246 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVL

SEQ ID NO: 5906 - protein, 247 aa, Artificial Sequence
  Description of Artificial Sequence: Synthetic single chain variable fragment sequence
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTVSSGGGGSGGGGSGGGGSQSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVL

SEQ ID NO: 5907 - protein, 246 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTVSSGGGGSGGGGSGSGGSQSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVL

SEQ ID NO: 5908 - protein, 244 aa, Artificial Sequence
  Description of Artificial Sequence: Synthetic single chain variable fragment sequence
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTVSSGGGGSGGGGSGGGGSHVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVL

SEQ ID NO: 5909 - protein, 241 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTVSSGGGGSGGGGSGGGGSQSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVL

SEQ ID NO: 5910 - protein, 247 aa, Artificial Sequence
  Description of Artificial Sequence: Synthetic single chain variable fragment sequence
EVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVL

SEQ ID NO: 5911 - protein, 244 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVL

SEQ ID NO: 5912 - protein, 252 aa, Artificial Sequence
  Description of Artificial Sequence: Synthetic single chain variable fragment sequence
EVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKR

SEQ ID NO: 5913 - protein, 250 aa, Artificial Sequence
  Description of Artificial Sequence: Synthetic single chain variable fragment sequence
QVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTVSSGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKR

SEQ ID NO: 5914 - protein, 247 aa, Artificial Sequence
  Description of Artificial Sequence: Synthetic single chain variable fragment sequence
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTVSSGGGGSGGGGSGGGGSGGGGSSYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVL

SEQ ID NO: 5915 - protein, 250 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTVSSGGGGSGGGGSGGGGSGGGRSSYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVL

SEQ ID NO: 5916 - protein, 252 aa, Artificial Sequence
  Description of Artificial Sequence: Synthetic single chain variable fragment sequence
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTVSSGGGGSGGGGSGGGGSGGGGSDIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIK

SEQ ID NO: 5917 - protein, 252 aa, Artificial Sequence
  Description of Artificial Sequence: Synthetic single chain variable fragment sequence
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVL

SEQ ID NO: 5918 - protein, 247 aa, Artificial Sequence
  Description of Artificial Sequence: Synthetic single chain variable fragment sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTVSSGGGGSGGGGSGGGGSGGGGSEIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKT

SEQ ID NO: 5919 - protein, 254 aa, Artificial Sequence
  Description of Artificial Sequence: Synthetic single chain variable fragment sequence
QVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTVSSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIK

SEQ ID NO: 5920 - protein, 248 aa, Artificial Sequence
  Description of Artificial Sequence: Synthetic single chain variable fragment sequence
QVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTVSSGGGGSGGGGSGGGGSEIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIK

SEQ ID NO: 5921 - protein, 247 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTVSSGGGGSGGGGSGGGGSSSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVL

SEQ ID NO: 5922 - protein, 246 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVL

SEQ ID NO: 5923 - protein, 248 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTVSSGGGGSGGGGSGGGGSQSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVL

SEQ ID NO: 5924 - protein, 246 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVL

SEQ ID NO: 5925 - protein, 244 aa, Artificial Sequence
  Description of Artificial Sequence: Synthetic single chain variable fragment sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKR

SEQ ID NO: 5926 - protein, 248 aa, Artificial Sequence
  Description of Artificial Sequence: Synthetic single chain variable fragment sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKR

SEQ ID NO: 5927 - protein, 242 aa, Artificial Sequence
  Description of Artificial Sequence: Synthetic single chain variable fragment sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKR

SEQ ID NO: 5928 - protein, 436 aa, Artificial Sequence
  Description of Artificial Sequence: Synthetic single chain variable fragment sequence
MGWSYIILFLVATATGVHSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEIKGGGGSGGGGSGGGGSQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPDGGGSEQKLISEEDLNSAVDHHHHHH

SEQ ID NO: 5929 - protein, 439 aa, Artificial Sequence
  Description of Artificial Sequence: Synthetic single chain variable fragment sequence
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPDGGGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEIKGGGSEQKLISEEDLNSAVDHHHHHH

SEQ ID NO: 5930 - protein, 246 aa, Artificial Sequence
  Description of Artificial Sequence: Synthetic single chain variable fragment sequence
LLHESGAEVAKPGASVKMSCKASGYTFTTYWMHWIKQRPGQGLEWIGYINPSTGYTDYNQNFKDKATLTADKSSRTAYMQLSSLTSEDSTVYYCTRRGPSYGNHGAWFPYWGQGTLVTVSAVSSGGGGSGGGGSGGGGSTNIVMTQSPRSMSMSVGERVTLSCKASENVDTYVSWYQQKPEQSPKLLIYGASNRYTGVPDRFTGSGSATDFTLTISSVQAEDLADYHCGQSYRYPPTFGGGTKLEI

SEQ ID NO: 5931 - protein, 252 aa, Artificial Sequence
  Description of Artificial Sequence: Synthetic single chain variable fragment sequence
RMAQVQLQQSGAELARPGASVKMSCKASGYTFTTYTIHWVRRRPGHDLEWIGYINPSSGCSDYNQNFKGKTTLTADKSSNTAYMQLNSLTSEDSAVYYCARRADYGNYEYTWFAYWGQGTTVTVSSSGGGSGGGGSGGGGSVIELTQSPKFMSTSVGDRVNVTYKASQNVGTNVAWFQQKPGQSPKVLIYSASYRYSGVPDRFTGSGSGTDFTLTISNVQSEDLAEYFCQQYHTYPLTFGGGTKLEIKRSDP

SEQ ID NO: 5932 - protein, 250 aa, Artificial Sequence
  Description of Artificial Sequence: Synthetic single chain variable fragment sequence
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 5933 - protein, 251 aa, Artificial Sequence
  Description of Artificial Sequence: Synthetic single chain variable fragment sequence
QVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 5934 - protein, 250 aa, Artificial Sequence
  Description of Artificial Sequence: Synthetic single chain variable fragment sequence
QVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 5935 - protein, 240 aa, Artificial Sequence
  Description of Artificial Sequence: Synthetic single chain variable fragment sequence
QVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 5936 - protein, 248 aa, Artificial Sequence
  Description of Artificial Sequence: Synthetic single chain variable fragment sequence
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 5937 - protein, 245 aa, Artificial Sequence
  Description of Artificial Sequence: Synthetic single chain variable fragment sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 5938 - protein, 244 aa, Artificial Sequence
  Description of Artificial Sequence: Synthetic single chain variable fragment sequence
QVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 5939 - protein, 267 aa, Artificial Sequence
  Description of Artificial Sequence: Synthetic single chain variable fragment sequence
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKRSDP

SEQ ID NO: 5940 - protein, 271 aa, Artificial Sequence
  Description of Artificial Sequence: Synthetic single chain variable fragment sequence
MALPVTALLLPLALLLHAARPQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 5941 - protein, 272 aa, Artificial Sequence
  Description of Artificial Sequence: Synthetic single chain variable fragment sequence
MALPVTALLLPLALLLHAARPQVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 5942 - protein, 270 aa, Artificial Sequence
  Description of Artificial Sequence: Synthetic single chain variable fragment sequence
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 5943 - protein, 271 aa, Artificial Sequence
  Description of Artificial Sequence: Synthetic single chain variable fragment sequence
MALPVTALLLPLALLLHAARPQVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 5944 - protein, 261 aa, Artificial Sequence
  Description of Artificial Sequence: Synthetic single chain variable fragment sequence
MALPVTALLLPLALLLHAARPQVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 5945 - protein, 269 aa, Artificial Sequence
  Description of Artificial Sequence: Synthetic single chain variable fragment sequence
MALPVTALLLPLALLLHAARPQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 5946 - protein, 266 aa, Artificial Sequence
  Description of Artificial Sequence: Synthetic single chain variable fragment sequence
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 5947 - protein, 266 aa, Artificial Sequence
  Description of Artificial Sequence: Synthetic single chain variable fragment sequence
MALPVTALLLPLALLLHAARPQVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 5948 - protein, 265 aa, Artificial Sequence
  Description of Artificial Sequence: Synthetic single chain variable fragment sequence
MALPVTALLLPLALLLHAARPQVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 5949 - protein, 267 aa, Artificial Sequence; identical to SEQ ID NO: 5939
  Description of Artificial Sequence: Synthetic single chain variable fragment sequence

SEQ ID NO: 5950 - protein, 250 aa, Artificial Sequence; identical to SEQ ID NO: 5932
  Description of Artificial Sequence: Synthetic single chain variable fragment sequence

SEQ ID NO: 5951 - protein, 251 aa, Artificial Sequence; identical to SEQ ID NO: 5933
  Description of Artificial Sequence: Synthetic single chain variable fragment sequence

SEQ ID NO: 5952 - protein, 249 aa, Artificial Sequence
  Description of Artificial Sequence: Synthetic single chain variable fragment sequence
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 5953 - protein, 250 aa, Artificial Sequence; identical to SEQ ID NO: 5934
  Description of Artificial Sequence: Synthetic single chain variable fragment sequence

SEQ ID NO: 5954 - protein, 240 aa, Artificial Sequence; identical to SEQ ID NO: 5935
  Description of Artificial Sequence: Synthetic single chain variable fragment sequence

SEQ ID NO: 5955 - protein, 248 aa, Artificial Sequence; identical to SEQ ID NO: 5936
  Description of Artificial Sequence: Synthetic single chain variable fragment sequence

SEQ ID NO: 5956 - protein, 245 aa, Artificial Sequence; identical to SEQ ID NO: 5937
  Description of Artificial Sequence: Synthetic single chain variable fragment sequence

SEQ ID NO: 5957 - protein, 245 aa, Artificial Sequence
  Description of Artificial Sequence: Synthetic single chain variable fragment sequence
QVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 5958 - protein, 244 aa, Artificial Sequence; identical to SEQ ID NO: 5938
  Description of Artificial Sequence: Synthetic single chain variable fragment sequence

SEQ ID NO: 5959 - protein, 246 aa, Artificial Sequence
  Description of Artificial Sequence: Synthetic single chain variable fragment sequence
NIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGGGGSGGGGSSGGGSQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSS

SEQ ID NO: 5960 - protein, 246 aa, Artificial Sequence
  Description of Artificial Sequence: Synthetic single chain variable fragment sequence
EIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSSGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSS

SEQ ID NO: 5961 - protein, 511 aa, Artificial Sequence
  Description of Artificial Sequence: Synthetic single chain variable fragment sequence
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 5962 - protein, 728 aa, Artificial Sequence
  Description of Artificial Sequence: Synthetic single chain variable fragment sequence
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGKHHHHHH

SEQ ID NO: 5963 - protein, 728 aa, Artificial Sequence
  Description of Artificial Sequence: Synthetic single chain variable fragment sequence
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGKHHHHHH

SEQ ID NO: 5964 - protein, 214 aa, Artificial Sequence
  Description of Artificial Sequence: Synthetic single chain variable fragment sequence
DIQMTQSPSSLSVSVGERVTITCRASENIRSNLAWYQQKPGKSPKLLVNVATNLADGVPSRFSGSGSGTDYSLKINSLQPEDFGTYYCQHYWGTTWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5965 - protein, 115 aa, Artificial Sequence
  Description of Artificial Sequence: Synthetic single chain variable fragment sequence
QVQVQESGPGLVAPSQTLSITCTVSGFSLTTSGVSWVRQPPGKGLEWLGVIWGDGSTNYHSSLKSRLSIKKDHSKSQVFLKLNSLTAADTATYYCAKGGYSLAHWGQGTLVTVSS

SEQ ID NO: 5966 - protein, 68 aa, Artificial Sequence
  Description of Artificial Sequence: Synthetic single chain variable fragment sequence
FWVLVVVGGVLACYSLLVTVAFIIFWVRSKRSRLLHSDYMNMTPRRPGPTRKHYQPYAPPRDFAAYRS

SEQ ID NO: 5967 - protein, 242 aa, Artificial Sequence
  Description of Artificial Sequence: Synthetic single chain variable fragment sequence
QVQLQESGGGLVKPGGPLRLSCAASGFTFSSYGMYWVRQAPGKGLEWVSTLSRSGSGTYYADSVKGRFTISRBNSKNTLYLQMNSLRAEDTAVYYCASIAVAGNYFDYWGQGTLVTVSSGGGGSGGGGSGGGGSSYVLTQDPAVSVALGQTVRITCQGDSLRSYYASWYQERPGQAPLLVIYGKNNRPSGIPDRFSGSNSGSTATLTISRVEAGDEGDYYCQVWDSINEQVVFGGGTKVTVL

SEQ ID NO: 5968 - protein, 241 aa, Artificial Sequence
  Description of Artificial Sequence: Synthetic single chain variable fragment sequence
QVQLVQSGGGVVQPGRSLRLSCAATGIPFSGSGMHWVRQAPGKGLEWVTMIWYDGSNKFYADSVKGRFTISRDNSKNTLYLQMDSLRAEDTAVYFCARDKGVRSMDVWGLGTTVTVSSGGGGSGGGGSGGGGSNFMLTQPPSVSVAPGQTAKITCDGYSIRTKSVHWYQQKPGQAPVVVVHDDSDRPSGIPERFSGSNSGTTATLTISRVEAGDEADYYCQAWDSISEEVVFGGGTKLTVL

SEQ ID NO: 5969 - protein, 239 aa, Artificial Sequence
  Description of Artificial Sequence: Synthetic single chain variable fragment sequence
QVQLQESGGGLVQPGGSLRLSCSASGFTFGTYAMRWVRQTSGKGLEWVSGIGVSGDAYYTDSVRGRFTISRDNSKNTLYLQMNTLRAEDTAYYCTRKSSTTSNDYWGRGTLVTVSSGGGGSGGGGSGGGGSSYVLTQDPAVSVALGQTVRITCQGDNIGSKSVHWYQQKPGQAPVLVVYDDSDRPSGIPERFSGSNSGTTATLTISSVEAGDEADYYCQAWDSISEHVIFGGGTKVTVL

SEQ ID NO: 5970 - protein, 238 aa, Artificial Sequence
  Description of Artificial Sequence: Synthetic single chain variable fragment sequence
QVQLQESGGGLVQPGGSLRLSCAASGTFSSYAMHWVRQAPGKGLEWVAVISYDGSNKYYADSVKGRFTISRDNSKNTLYLQMNSLRAEDTAVYYCARFSSGWYYFDYWGQGTLVTVSSGGGGSGGGGSGGGGSDIQMTQSPSFLSASVGDRITITCRASNDISSYFAWYQQKPGKAPKPLIYAASTLQSGVPSRFSGSGTEFTLTISSLQPEDFATYYCQQLGSYPLTFGGGTKLEIK

SEQ ID NO: 5971 - protein, 245 aa, Artificial Sequence
  Description of Artificial Sequence: Synthetic single chain variable fragment sequence
QVQLLQSGGGLVQPGGSLRLSCAASGFTFSSYAMSWVRQAPGKGLEWVSAISGSGGSTYYTDSVKGRFTISRDNSKNTLYLQMNSLRAEDTAVYYCAKSHDYGDYAGFDYWGQGTLVTVSSGGGGSGGGGSGGGGSHVILTQDPAVSVALGQTVRITCQGDSLKSYYASWYQQKPGQAPVLVIYGKNNRPSGIPDRFSGSSSGTTASLTITGAQAEDEADYYCHSRDSSGTHLRVFGGGTKLTVL

SEQ ID NO: 5972 - protein, 244 aa, Artificial Sequence
  Description of Artificial Sequence: Synthetic single chain variable fragment sequence
QVQLQESGGGLVKPGGSLRLSCAASGFTFSNAWMNWVRQAPGKGLEWVGRIKSKTDEGTTDYAAPVKGRFSISRDDSKNTLYLQMNSLKTEDTGVYYCTATKGLGGSKLGQGTLVTVSSGGGGSGGGGSGGGGSQSVLTQPPSASGTPGQRVTISCSGSSSNIGNNTVNWSRQLPGTAPKLLIYSNDQRPSGVPDRFSGSKSGTSASLAITGLQPEDEADYYCGTWDSSLSAYVFGTGTKLTVL

SEQ ID NO: 5973 - protein, 244 aa, Artificial Sequence
  Description of Artificial Sequence: Synthetic single chain variable fragment sequence
QVQLVESGGGWQPGRSLRLSCAASGFTFSSFGMHWVRRAPGKGLEWVAVISYDGSNQYYADSVKGRFTISRDNSKNTLYLQMNSLRAEDTAVYYCGSRPGGGYASGSTVAYWGQGTPVTVSSGGGGSGGGGSGGGGSSSELTQDPAVSVALGQTVRITCQGDSLRSYYASWYQQKPGQAPLLVIYGQNIRPSGIPDRFSGSSSGNSASLTITGAQAEDEADYYCHSRDSSGKYVFGVGTKVTVL

SEQ ID NO: 5974 - protein, 237 aa, Artificial Sequence
  Description of Artificial Sequence: Synthetic single chain variable fragment sequence
QVQLVESGGGLVQPGGSLRLSCAASGFTFSSYAMGWVRQAPGKGLEWVSAISGSGGSTYYADSVKGRFTISRDNSKDTLYLQMNSLRAEDTAVYYCASRSLLDYWGQGTLVTVSSGGGGSGGGGSGGGGSNFMLTQDPAVSVALGQTVRITCQGDSLRSYYASWYQQKPGQAPLLVIYGKNNRPSGIPDRFSGSSSGNTASLTITGAQAEDEADYYCNSRDSSGNPVFGGGTKVTVL

SEQ ID NO: 5975 - protein, 237 aa, Artificial Sequence
  Description of Artificial Sequence: Synthetic single chain variable fragment sequence
QVQLVESGGGLVQPGGSLRLSCAASGFTFSSYAMSWVRQAPGKGLEWVSAISGSGGSTYYADSVKGRFTISRDNSKDTLYLQMNSLRAEDTAVYYCASRSLLDYWGQGTLVTVSSGGGGSGGGGSGGGGSNFMLTQDPAVSVALGQTVRITCQGDSLRSYYASWYQQKPGQAPLLVIYGKNNRPSGIPDRFSGSSSGNTASLTITGAQAEDEADYYCNSRDSSGNPVFGGGTKVTVL

SEQ ID NO: 5976 - protein, 243 aa, Artificial Sequence
  Description of Artificial Sequence: Synthetic single chain variable fragment sequence
QVQLQESGGGLVQLGGSLRLSCAASGFTFSSYAMSWVRQAPGKGLEWVSAISGSGGSTYYADSVKGRFTISRDNSKNTLYLQMSSLRAEDTAFYYCANSAYTGGWYDYWGHGTLVTVSSGGGGSGGGGSGGGGSSSELTQDPAVSVALGQTVKITCQGDSLRTYYASWYQQRPGQAPVLVIYGENSRPSGIPDRFSGSSSGNTASLTITGAQAEDEADYYCNSRDSSGNHLRVFGGGTKLTVL

SEQ ID NO: 5977 - protein, 234 aa, Artificial Sequence
  Description of Artificial Sequence: Synthetic single chain variable fragment sequence
QVNLRESGGGLVQPGGFLRLSCAAFGFTFSGYWMSWVHPAPGKGLEWVANIKQDGSEKFYVDSVKGRFTISRDNAKNSLFLQMNSLRAEDTAVYFCARGLLSDYWGQGTLVPVSSGGGGSGGGGSGGGGSNFMLTQPPSVSVAPGKTASLTCGGYNIGTKSVHWYQQKPGQAPWWHDDSDRPSGIPERFSGSNSGTTATLIIRVEAGDEADYYCQAWDSISEEWFGGGTKLTVL

SEQ ID NO: 5978 - protein, 241 aa, Artificial Sequence
  Description of Artificial Sequence: Synthetic single chain variable fragment sequence
QVQLQESGGGLVKPGGPLRLSCAASGFTFSSYGMYWVRQAPGKGLEWVSTLSRSGSGTYYAESVKGRFTISRDNSKNTLYFQMNSLRAEDTAVYYCASIAVAGNYFEYWGQGTLVTVSSGGGGSGGGGSGGGGSSYVLTQDPAVSVALGQTVRITCQGDSLRSYYASWYQERPGQAPLLVIYGKNNRPSGIPDRFSGSNSGSTATLTISRVEAGDEGDYYCQVWDSINEQWFGGGTKVTVL

SEQ ID NO: 5979 - protein, 241 aa, Artificial Sequence
  Description of Artificial Sequence: Synthetic single chain variable fragment sequence
QVQLQESGGGLVKPGESLRLSCAASGFTFSDHYMDWVRQAPGKGLEWVAYIRYDGSTKYYADSVKGRFTISRDNSKNTLYLQMNSLRPEDTAFYYCARLIAEAEGWFDPWGQGTLVTVSSGGGGSGGGGSGGGGSNFMLTQPPSVSVAPGKTARITCGGNNIGSKSVYWYQQKPGQAPVLWYDDSDRPSGIPERFSGSNSGNTATLTISRVEAGDEADYYCQVWDSSSDHWFGGGTKVTVL

SEQ ID NO: 5980 - protein, 240 aa, Artificial Sequence
  Description of Artificial Sequence: Synthetic single chain variable fragment sequence
QVQLLQSAGGLVQPGGSLRLSCAASGFTFSTYAMNWVRQAPGKGLEWVSGISGSGGSTNYADSVKGRFTISRDSSKNTLFLQMNSLRAEDTAVYYCAKDYGSGWYDYWGQGTLVTVSSGGGGSGGGGSGGGGSSSELTQDPAVSVALGQTVRITCQGDSLRSYYASWYQERPGQAPLLVIYGRNERPSGIPDRFSASSSGNTASLTITGAQAEDEADYYCQVWDSFNEQWFGGGTKLTVL

SEQ ID NO: 5981 - protein, 245 aa, Artificial Sequence
  Description of Artificial Sequence: Synthetic single chain variable fragment sequence
QVQLVESGGGLVQPGGSLRLSCAASGFTFSSYAMSWVHQAPGKGLEWVSAISGSGGSTYYADSVKGRFTISRDNSKNTLYLQMNSLRAEDTAVYYCAKTYYGFWSGYYDYLGQGTLVTVSSGGGGSGGGGSGGGGSSSELTQDPAVSVGLGQTVTITCQGDSLRSYYANWYQQKPGQAPILVIYGENNRPSGIPDRFSGSSSGNTASLTITGAQAEDEADYYCHSRDSSGTHLRVFGGGTKLTVL

SEQ ID NO: 5982 - protein, 243 aa, Artificial Sequence
  Description of Artificial Sequence: Synthetic single chain variable fragment sequence
QVQLLESGGGWQPGTSLRLSCAASGFTFSNYAINWVRQAAGKGLEWVSGISGSGVSTSYADSVKGRFTVSRDNSKNTLYLQMNSLRVEDTALYYCAKNGGGPEYLQHWGQGTLVTVSSGGGGSGGGGSGGGGSQSVLTQPPSASGTPGQRVTISCSGSSSNIGNNTVNWSRQLPGTAPKLLIYSNDQRPSGVPDRFSGSKSGTSASLAITGLQPEDEADYYCGTWDSSLSAYVFGTGTKLTVL

SEQ ID NO: 5983 - protein, 235 aa, Artificial Sequence
  Description of Artificial Sequence: Synthetic single chain variable fragment sequence
QVQLQESGGTLVQPGGSLRLSCAASGFTFSSYAMSWVRQAPGRGLEWVSTISGSGGSTYYADSVKGRFTISRDNSKNTLYLQMNSLRAEDTAVYYCAKGAYSGSYWGQGTLVTVSSGGGGSGGGGSGGGGSSSELTQDPAVSVALGQTVRITCQGDSLRSYYASWYQQKPGQAPSLVIYGENSRPSGIPDRFSGSSSGNTASLIGAQAENEADYYCQAWDSSTAWFGGGTKLTVL

SEQ ID NO: 5984 - protein, 237 aa, Artificial Sequence
  Description of Artificial Sequence: Synthetic single chain variable fragment sequence
QVQLQESGGTLVQPGGSLRLSCAASGFTFSSYAMSWVRQAPGRGLEWVSTISGSGGSTYYADSVKGRFTISRDNSKNTLYLQMNSLRAEDTAVYYCAKGAYSGSHWGQGTLVTVSSGGGGSGGGGSGGGGSSSELTQDPAVSVALGQTVRITCQGDSLRSYYASWYQQKPGQAPSLVIYGENSRPSGIPDRFSGSSSGNTASLTITGAQAENEADYYCQAWDSSTAWFGGGTKLTVL

SEQ ID NO: 5985 - protein, 244 aa, Artificial Sequence
  Description of Artificial Sequence: Synthetic single chain variable fragment sequence
QVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARPIYDSSGYDAFDIWGQGTMVTVSSGGGGSGGGGSGGGGSDIVMTQSPSTLSASIGDRVTITCRASEGIYHWLAWYQQKPGKAPKLLIYKASSLASGAPSRFSGSGSGTDFTLTISSLQPDDFATYYCQQYHTISRTFGPGTKVDIK

SEQ ID NO: 5986 - protein, 244 aa, Artificial Sequence
  Description of Artificial Sequence: Synthetic single chain variable fragment sequence
QVQLVESGGGLVKPGGSLRLSCAASGFTFSSYAMHWVRQAPGKGLEWVAVISYDGSNKYYADSVKGRFTISRDNSKNTLYLQMNSLRAEDTAVYFCVRPSDSGWSFEHWGQGTLVPVSSGGGGSGGGGSGGGGSQSVLTQPPSASGTPGQRVTISCSGSSSNIGNNTVNWSRQLPGTAPKLLIYSNDQRPSGVPDRFSGSKSGTSASLAITGLQPEDEADYYCGTWDSSLSAYVFGTGTKLTVL

SEQ ID NO: 5987 - protein, 245 aa, Artificial Sequence
  Description of Artificial Sequence: Synthetic single chain variable fragment sequence
QVQLQESGGGLVQPGGSLRLSCAASGFTFSSYAMSWVRQAPGKGLEWVAVISYDGSNKYYADSVKGRFTISRDNSKNTLYLQMNSLRAEDTAVYYCVRGDRSYGAEYFQHWGQGTLVTVSSGGGGSGGGGSGGGGSSSELTQDPAVSVASGQTVRITCQGDSLRSYYASWYQQKPGQAPLLVIYGKNIRPSGIPDRFSGSTSGNSASLTITGAQAEDEADYYCNSRDSSGNRNWVFGGGTKLTVL

SEQ ID NO: 5988 - protein, 245 aa, Artificial Sequence
  Description of Artificial Sequence: Synthetic single chain variable fragment sequence
QVQLQESGGGLVKPGGSLRLSCAASGFTSSSYAMHWVRQAPGKGLEYVSAIGGNGGTYYADSVKGRFTISRDNSKNTLYLQMNSLRAEDTAVYYCAKEGEQWLEYRYYYGMDVWGQGTTVTVSSGGGGSGGGGSGGGGSSSELTQDPAVSVALGQTVRITCQGDSLRSYYASWYQQKPGQAPSLVIYGENSRPSGIPDRFSGSSSGNTASLTITGAQAENEADYYCQAWDSSTAWFGGGTKLTVL

SEQ ID NO: 5989 - protein, 247 aa, Artificial Sequence
  Description of Artificial Sequence: Synthetic single chain variable fragment sequence
QVQLVESGGGWQPGRSLRLSCTASGFTFSSYGMHWVRQAPGKGLEWVAVISYDGSNKYYADSVKGRFTISRDNSKNTLYLQMNSLRAEDTAVYYCARGGRYSSNWFSYYYYGMDVWGQGTTVTVSSGGGGSGGGGSGGGGSNFMLTQPPSVSVAPGKTARITCGGNNIGSKSVYWYQQKPGQAPVLWYDDSDRPSGIPERFSGSNSGNTATLTISRVEAGDEADYYCQVWDSSSDHWFGGGTKVTVL

SEQ ID NO: 5990 - protein, 324 aa, Artificial Sequence
  Description of Artificial Sequence: Synthetic single chain variable fragment sequence
MALPVTALLLPLALLLHAARPDIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIKGGGGSGGGGSGGGGSEVQLQESGPGLVKPSQTLSLTCSVTGYSITSGYYWHWIRQFPGNKLQWMGYISYSGFTNYKTSLINRISITHDTSENQFFLNLNSVTTEDTATYYCAGDRTGSWFAYWGQGTLVTVSATTTPAPRPPTPAPTIASQPLSLRPEACRPAAGGAVHTRGDFACDIYIWAPLAGTLSLVITLYC

SEQ ID NO: 5991 - protein, 252 aa, Artificial Sequence
  Description of Artificial Sequence: Synthetic single chain variable fragment sequence
DIVLTQSPASLAVSLGQRATISCKASQSVDYDGDGYMDWYQQKPGQPPKLLIFAASNLKSGIPARFSGSGSGTDFTLNIHPVEEEDAATYYCQQTNEYPWTFGGGTKLEIKGSTSGSGKPGSGEGSTKGQIQLVQSGPELKKPGETVKISCKASGYTFTDYSMHWVKQAPGEGLKWMGWINTETGEPTYADDFKGRFAFSLETSASTAYLQINNLKNEDTATYFCYYGSYWGQGTLVTVSAGGGGSGGGGSC

SEQ ID NO: 5992 - protein, 213 aa, Artificial Sequence
  Description of Artificial Sequence: Synthetic single chain variable fragment sequence
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5993 - protein, 257 aa, Artificial Sequence
  Description of Artificial Sequence: Synthetic single chain variable fragment sequence
MSVPTQVLGLLLLWLTGARCDIQMTQSPASLSASVGDTVTITCRASENIYSYLAWYQQKQGKSPQLLVYNAKALSEGVPSRFSGSGSGTQFSLRINSLQPEDFGDYYCQHHYNSPYTFGGGTKLEIKGSTSGSGKSSEGKGQIQLVQSGPELKKPGETVKISCKASGYSFTNDGINWVKQAPGKGFKYMGWINTITGEPTYTEDFKGRFAFSLETSASTAYLQINNLKDEDTATFFCAKGTGTSAYWGQGTLVTVSA

SEQ ID NO: 5994 - protein, 257 aa, Artificial Sequence; identical to SEQ ID NO: 5993
  Description of Artificial Sequence: Synthetic single chain variable fragment sequence

SEQ ID NO: 5995 - protein, 256 aa, Artificial Sequence
  Description of Artificial Sequence: Synthetic single chain variable fragment sequence
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRGSTSGSGKPGSGEGSTKGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSC

SEQ ID NO: 5996 - protein, 256 aa, Artificial Sequence; identical to SEQ ID NO: 5995
  Description of Artificial Sequence: Synthetic single chain variable fragment sequence

SEQ ID NO: 5997 - protein, 480 aa, Artificial Sequence
  Description of Artificial Sequence: Synthetic single chain variable fragment sequence
MALPVTALLLPLALLLHAARPDIQMTQSPSSLSASVGDRVTITCKAGQNVGTSVAWFQQKPGKAPKSLIYSASYRYSGVPSRFSGSGSGTDFTLTISSLQPEDFATYYCQQYITYPYTFGGGTKVEIKGGGGSGGGGSGGGGSEVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCTGPAYWGQGTLVTVSSSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5998 - protein, 242 aa, Artificial Sequence
  Description of Artificial Sequence: Synthetic single chain variable fragment sequence
SQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELK

SEQ ID NO: 5999 - protein, 249 aa, Artificial Sequence
  Description of Artificial Sequence: Synthetic single chain variable fragment sequence
EIVLTQSPATLSLSPGERATLSCSVSSSISSSNLHWYQQKPGQAPRLLIYGTSNLASGIPARFSGSGSGTDFTLTISSLEPEDFAVYYCQQWSSYPHTFGGGTKVEIKGGGGSGGGGSGGGGSQVQLVQSGAEVKKPGASVKVSCKASGYTFTNYLIEWVRQAPGQGLEWMGLINPGSGGTNYNEKFKGRVTMTTDTSTSTAYMELRSLRSDDTAVYYCARRSPLGSWIYYAYDGVAYWGQGTLVTVSS

SEQ ID NO: 6000 - protein, 234 aa, Artificial Sequence
  Description of Artificial Sequence: Synthetic single chain variable fragment sequence
DIQMTQSPSSLSASVGDRVTITCKAGQNVGTSVAWFQQKPGKAPKSLIYSASYRYSGVPSRFSGSGSGTDFTLTISSLQPEDFATYYCQQYITYPYTFGGGTKVEIKGGGGSGGGGSGGGGSEVQLLESGGGLVQPGGSLRLSCAASGFTFSRYWMSWVRQAPGKGLEWVSEINPDSSTIQYTPSLKARFTISRDNSKNTLYLQMNSLRAEDTAVYYCTGPAYWGQGTLVTVSS

SEQ ID NO: 6001 - protein, 493 aa, Artificial Sequence
  Description of Artificial Sequence: Synthetic single chain variable fragment sequence
MALPVTALLLPLALLLHAARPEIVLTQSPATLSLSPGERATLSCSVSSSISSSNLHWYQQKPGQAPRLLIYGTSNLASGIPARFSGSGSGTDFTLTISSLEPEDFAVYYCQQWSSYPHTFGGGTKVEIKGGGGSGGGGSGGGGSQVQLVQSGAEVKKPGASVKVSCKASGYTFTNYLIEWVRQAPGQGLEWMGLINPGSGGTNYNEKFKGRVTMTTDTSTSTAYMELRSLRSDDTAVYYCARRSPLGSWIYYAYDGVAYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6002 - protein, 244 aa, Artificial Sequence
  Description of Artificial Sequence: Synthetic single chain variable fragment sequence
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPSIMSVSPGEKVTITCSASSSVSYMHWFQQKPGTSPKLCIYSTSNLASGVPARFSGRGSGTSYSLTISRVAAEDAATYYCQQRSNYPPWTFGGGTKLEIK

SEQ ID NO: 6003 - protein, 244 aa, Artificial Sequence
  Description of Artificial Sequence: Synthetic single chain variable fragment sequence
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPAIMSASPGEKVTITCSASSSVSYLHWFQQKPGTSPKLWVYSTSNLPSGVPARFGGSGSGTSYSLTISRMEAEDAATYYCQQRSIYPPWTFGGGTKLEIK

SEQ ID NO: 6004 - protein, 244 aa, Artificial Sequence
  Description of Artificial Sequence: Synthetic single chain variable fragment sequence
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPSIMSVSPGEKVTITCSASSSVSYMHWFQQKPGTSPKLGIYSTSNLASGVPARFSGRGSGTSYSLTISRVAAEDAATYYCQQRSNYPPWTFGGGTKLEIK

SEQ ID NO: 6005 - protein, 239 aa, Artificial Sequence
  Description of Artificial Sequence: Synthetic single chain variable fragment sequence
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSQIVLTQSPSIMSVSPGEKVTITCSASSSVSYMHWFQQKPGTSPKLCIYSTSNLASGVPARFSGRGSGTSYSLTISRVAAEDAATYYCQQRSNYPPWTFGGGTKLEIK

SEQ ID NO: 6006 - protein, 241 aa, Artificial Sequence
  Description of Artificial Sequence: Synthetic single chain variable fragment sequence
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVST

SEQ ID NO: 6007 - protein, 241 aa, Artificial Sequence
  Description of Artificial Sequence: Synthetic single chain variable fragment sequence
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTGGGGSGGGGSGGGGSDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 6008 - protein, 247 aa, Artificial Sequence
  Description of Artificial Sequence: Synthetic single chain variable fragment sequence
EVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVL

SEQ ID NO: 6009 - protein, 245 aa, Artificial Sequence
  Description of Artificial Sequence: Synthetic single chain variable fragment sequence
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIK

SEQ ID NO: 6010 - protein, 247 aa, Artificial Sequence
  Description of Artificial Sequence: Synthetic single chain variable fragment sequence
QVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSSGGGGSGGGGSGGGGSDIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIK

SEQ ID NO: 6011 - protein, 239 aa, Artificial Sequence
  Description of Artificial Sequence: Synthetic single chain variable fragment sequence
QVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSSGGGGSGGGGSGGGGSEIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIK

SEQ ID NO: 6012 - protein, 245 aa, Artificial Sequence
  Description of Artificial Sequence: Synthetic single chain variable fragment sequence
EVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSSGGGGSGGGGSGSGGSDIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 6013 - protein, 249 aa, Artificial Sequence
  Description of Artificial Sequence: Synthetic single chain variable fragment sequence
QVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSSGGGGSGGGDSGGGGSDIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIK

SEQ ID NO: 6014 - protein, 255 aa, Artificial Sequence
  Description of Artificial Sequence: Synthetic single chain variable fragment sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 6015 - protein, 239 aa, Artificial Sequence
  Description of Artificial Sequence: Synthetic single chain variable fragment sequence
QVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIK

SEQ ID NO: 6016 - protein, 246 aa, Artificial Sequence
  Description of Artificial Sequence: Synthetic single chain variable fragment sequence
QVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSSGGGGSGGGGSGGGGSGGGGSDIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIK

SEQ ID NO: 6017 - protein, 248 aa, Artificial Sequence
  Description of Artificial Sequence: Synthetic single chain variable fragment sequence
QVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSSGGGGSGGGGSGGGGSGGGGSDIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIK

SEQ ID NO: 6018 - protein, 246 aa, Artificial Sequence
  Description of Artificial Sequence: Synthetic single chain variable fragment sequence
EVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSSGGGGSGGGGSGGGGSGGGGSEIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIK

SEQ ID NO: 6019 - protein, 255 aa, Artificial Sequence
  Description of Artificial Sequence: Synthetic single chain variable fragment sequence
QVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSSGGGGSGGGGSGGGGSGGGGSDIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIK

SEQ ID NO: 6020 - protein, 247 aa, Artificial Sequence
  Description of Artificial Sequence: Synthetic single chain variable fragment sequence
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIK

SEQ ID NO: 6021 - protein, 247 aa, Artificial Sequence; identical to SEQ ID NO: 6008
  Description of Artificial Sequence: Synthetic single chain variable fragment sequence

SEQ ID NO: 6022 - protein, 245 aa, Artificial Sequence
  Description of Artificial Sequence: Synthetic single chain variable fragment sequence
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEEVGIYYCMQGTHWSFTFGQGTRLEIK

SEQ ID NO: 6023 - protein, 247 aa, Artificial Sequence; identical to SEQ ID NO: 6010
  Description of Artificial Sequence: Synthetic single chain variable fragment sequence

SEQ ID NO: 6024 - protein, 239 aa, Artificial Sequence; identical to SEQ ID NO: 6011
  Description of Artificial Sequence: Synthetic single chain variable fragment sequence

SEQ ID NO: 6025 - protein, 245 aa, Artificial Sequence; identical to SEQ ID NO: 6012
  Description of Artificial Sequence: Synthetic single chain variable fragment sequence

SEQ ID NO: 6026 - protein, 249 aa, Artificial Sequence; identical to SEQ ID NO: 6013
  Description of Artificial Sequence: Synthetic single chain variable fragment sequence

SEQ ID NO: 6027 - protein, 255 aa, Artificial Sequence
  Description of Artificial Sequence: Synthetic single chain variable fragment sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESFGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 6028 - protein, 239 aa, Artificial Sequence; identical to SEQ ID NO: 6015
  Description of Artificial Sequence: Synthetic single chain variable fragment sequence

SEQ ID NO: 6029 - protein, 246 aa, Artificial Sequence; identical to SEQ ID NO: 6016
  Description of Artificial Sequence: Synthetic single chain variable fragment sequence

SEQ ID NO: 6030 - protein, 248 aa, Artificial Sequence; identical to SEQ ID NO: 6017
  Description of Artificial Sequence: Synthetic single chain variable fragment sequence

SEQ ID NO: 6031 - protein, 246 aa, Artificial Sequence; identical to SEQ ID NO: 6018
  Description of Artificial Sequence: Synthetic single chain variable fragment sequence

SEQ ID NO: 6032 - protein, 255 aa, Artificial Sequence; identical to SEQ ID NO: 6019
  Description of Artificial Sequence: Synthetic single chain variable fragment sequence

SEQ ID NO: 6033 - protein, 247 aa, Artificial Sequence
  Description of Artificial Sequence: Synthetic single chain variable fragment sequence
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQFEDFATYYCQQFNNYPLTFGGGTKVEIK

SEQ ID NO: 6034 - protein, 245 aa, Artificial Sequence
  Description of Artificial Sequence: Synthetic single chain variable fragment sequence
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIK

SEQ ID NO: 6035 - protein, 250 aa, Artificial Sequence
  Description of Artificial Sequence: Synthetic single chain variable fragment sequence
QVQLVQSGAEVKKPGESLKISCKGSGYTFTNYWIAWVRQMPGKGLEWMGIIYPDDSDTRYNPSFQGQVTMSADKSIDTAYLQWSSLKASDTAIYYCARPSGWNDNGYFDYWGRGTTVTVSSGGGGSGGGGSGGGGSALNFMLTQPHSVSASPGKTVTLSCTGSSGSIASNYVQWYRQRPGSAPTTVIYDDNQRPSGVPDRFSGSIDSSSNSASLTISGLKTEDEADYYCQSFDNDNHWVFGGGTKLTVLG

SEQ ID NO: 6036 - protein, 247 aa, Artificial Sequence
  Description of Artificial Sequence: Synthetic single chain variable fragment sequence
QVQLQESGPGLVRSSGILSLTCSVSGVSVSSNNWWSWVRQTPGKGLEWIGEIYQTGTTNYNPSLKSRVAISLDKSRNQFSLILKSVTAADTAVYYCARTSSAWSNADWGKGTMVTVSSGGGGSGGGGSGGGGSALSSELTQDPSASGSPGQSVSISCTGTSSDVGGYNYVSWYQQHPGKAPKLMISEVTKRPSGVPDRFSGSKSGNTASLTVSGLQAEDEADYYCSSFGANNNYLVFGGGTKLTVLG

SEQ ID NO: 6037 - protein, 251 aa, Artificial Sequence
  Description of Artificial Sequence: Synthetic single chain variable fragment sequence
QVQLQESGPRLVKPSQTLSLTCTVSNDSIISGDYFWSWIRQPPGKGLEWIGNIFYTGSTSYNPSLKSRLTMSLDTSKNQFSLRLSSVTAADTAVYFCARGRQGMNWNSGTYFDSWGRGTLVTVSSGGGGSGGGGSGGGGSALSYVLTQPPSVSVAPGKTANITCGGKNIGNKSVQWYQQKPGQAPVVVMYYDSDRPSGIPERFSGSNAGNTATLTIDRVEAGDEADYYCQVWDKSSDRPVFGGGTKLTVLG

SEQ ID NO: 6038 - protein, 245 aa, Artificial Sequence
  Description of Artificial Sequence: Synthetic single chain variable fragment sequence
QVQLVQSGAEVKKPGASVKVSCKTSGYTFMEYYIHWVRQAPGQGLEWMGWSNPVTGTSGSSPKFRGRVTLTTDTSGNTAYLDLRSLRSDDTAVFYCARRHQQSLDYWGQGTLVTVSSGGGGSGGGGSGGGGSAQSVVTQPPSASGSPGQSVTISCSGYSSSNIGNNAVSWYQQLPGTAPKLLIFDNNKRPSGIPARFSGSQSGTTATLGITGLQTGDEADYFCGTWDSSLSAFVFGSGTKVTVLG

SEQ ID NO: 6039 - protein, 246 aa, Artificial Sequence
  Description of Artificial Sequence: Synthetic single chain variable fragment sequence
EVQLVQSGAEVKKPGSSVKVSCKASGGSFSNYDFSWVRQAPGQGLEWMGEIINAFGSSRYAQKFQDRVTITADESASTAYMELRGLTSEDTATYYCARAERWELNMAFDMWGRGTLVTVSSGGGGSGGGGSGGGGSAQSVLTQPPSVSVAPGQTARITCGGDNIGRKNVHWYQQRPGLAPVLVVYDDTDRPSGIPERFSGSNSGDTATLTITWVEAGDEADYYCQLWDSDTYDVLFGGGTKLTVLG

SEQ ID NO: 6040 - protein, 247 aa, Artificial Sequence
  Description of Artificial Sequence: Synthetic single chain variable fragment sequence
EVQLVQSGAEVKKPGSSVKVSCKSSGGPFSSYGISWVRQAPGQGLEWMGGISPIFGTANYAQKFQGRVTITADESTETAYMELSSLRSEDTAVYYCARDESPVGFYALDIWGRGTTVTVSSGGGGSGGGGSGGGGSALSYELTQPPSVSVAPGQTARINCGGDKIGSRSVHWYQQKPGQAPVMVVYDDSDRPSGIPERFSGSNSGNTATLTISSVEAGDEADYYCQVWDGSTDPWVFGGGTKVTVLG

SEQ ID NO: 6041 - protein, 255 aa, Artificial Sequence
  Description of Artificial Sequence: Synthetic single chain variable fragment sequence
EVQLVQSGAEMKKPGSSVKVSCKASGGTFSSYAVNWVRQAPGQGLEWMGGIIPIFDTSNYAQKFQGRLTMTADDSTNTAYMELRSLRSEDTAVYYCARGAPRGTVMAFSSYYFDLWGQGTLVTVSSGGGGSGGGGSGGGGSALNFMLTQPHSVSESPGKTVIISCAGSGGNIATNYVQWYQHRPGSAPITVIYEDNQRPSGVPDRFSGSVDSSSNSASLTISGLQTEDEADYYCHSYDNTDQGVFGTGTKVTVLG

SEQ ID NO: 6042 - protein, 253 aa, Artificial Sequence
  Description of Artificial Sequence: Synthetic single chain variable fragment sequence
EVQLVESGGGLVQPGRSLRLSCAASGFTFDDYDMHWVRQAPGKGLEWVSSISWSGGTIGYADSVKGRFTVSRDNAKNSLYLQMNSVRAEDTALYYCAKDRGAVAALPDYQYGMDVWGRGTLVTVSSGGGGSGGGGSGGGGSAQSALTQPASVSGSPGQSITISCTGTSSDIGSYNLVSWYQQHPGKAPKLMIYEDYKRASGVSNHFSGSKSGNTASLTISGLQAEDEADYYCSSYAGSSAWVFGGGTKVTVLG

SEQ ID NO: 6043 - protein, 245 aa, Artificial Sequence
  Description of Artificial Sequence: Synthetic single chain variable fragment sequence
EVQLVQSGAEVRKPGSSMKVSCKASGDTFRNFAFSWVRQAPGQGLEWMGGVIPLVGPPKYAQKFQGRLTITADESTSTSYMDLTSLTLEDTAVYFCARGGVYAPFDKWGQGTLVTVSSGGGGSGGGGSGGGGSAQSVVTQPPSVSEAPRQRVTISCSGSSSNIGNNAVNWYQQLPGKAPKLLIYYNDLLPSGVSDRFSGSKSGTSASLAISGLQSEDEADYYCAAWDDSLNGWVFGGGTKVTVLG

SEQ ID NO: 6044 - protein, 244 aa, Artificial Sequence
  Description of Artificial Sequence: Synthetic single chain variable fragment sequence
QVQLVQSGAEVRKPGASVKVSCKTSGYTFIDYYIHWVRQAPGQGLEWMGWVNPVTGTSGSSPNFRGRVTMTTDTSGNTAYMELRSLRSDDTAVFYCARRHQQSLDYWGQGTLVTVSSGGGGSGGGGSGGGGSAQSVLTQPPSVSAPPGQKVTISCSGSSSNIGTNYVSWYQQLPGTAPKLLIYDNHKRPSVIPDRFSGSKSGTSATLGISGLQTGDEADYYCGTWDYSLSTWVFGGGTKLTVLG

SEQ ID NO: 6045 - protein, 248 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSAQAVLTQPSSVSAAPGQKVTISCSGSSSNIGNNYVSWYQQLPGTAPKLLIYDNNKRPSGIPDRFSGSRSGTSATLGITGLQTGDEADYYCGTWDSSLSAVVFGTGTKLTVLG

SEQ ID NO: 6046 - protein, 250 aa, Artificial Sequence
  Description of Artificial Sequence: Synthetic single chain variable fragment sequence
QLQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGKGTLVTVSSGGGGSGGGGSGGGGSAQSALTQPASVSGSPGQSIAISCTGTSSDVGGYNYVSWYQQHPGKAPKLMIYAVTNRPSGVSDRFSGSKSGNTASLTISGLQADDEADYYCSSYTSSSSLVFGGGTKLTVLG

SEQ ID NO: 6047 - protein, 240 aa, Artificial Sequence
  Description of Artificial Sequence: Synthetic single chain variable fragment sequence
GVQLVESGGGLVKPGGSLRLSCAASGFTFSSYTMNWVRQAPGKGLEWVSYISSSGSATYYADSVKGRFTISRDNANNSLYLQMNSLRAEDTAVYYCARGYRYGMDVWGQGTLVTVSSGGGGSGGGGSGGGGSGIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 6048 - protein, 246 aa, Artificial Sequence
  Description of Artificial Sequence: Synthetic single chain variable fragment sequence
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKSSSSWYRSYYFDYWGQGTLVTVSSGGGGGSGGGGSGGGGSQSALTQDPAVSVALGQTVRITCRGDSLRNYYASWYQQKPGQAPVLVIYGKNNRPSGIPDRFSGSFSGNTASLTITGAQAEDEADYYCNSRDSSANQMFGGGTKVTVLG

SEQ ID NO: 6049 - protein, 249 aa, Artificial Sequence
  Description of Artificial Sequence: Synthetic single chain variable fragment sequence
QVQLQQSGAEVRKPGASVKISCKTSGYTFMDYYIHWVRQAPGQGLEWMGWSNPVTGTSGSSPKFRGRVTLTTDTSGNTAYLDLRSLRSDDTAVFYCARRHQQSLDYWGQGTLVTVSSGGGGSGGGGSGGGGSAQAVLTQPSSLSASPGASASLTCTLRSDINVGSYSINWYQQKPGSPPQYLLNYRSDSDKQQGSGVPSRFSGSKDASANAGILLISGLQSEDEADYYCMIWYRTAWVFGGGTKVTVLG

SEQ ID NO: 6050 - protein, 245 aa, Artificial Sequence
  Description of Artificial Sequence: Synthetic single chain variable fragment sequence
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCASQHVGEQSRYFDYWGQGTLVTVSSGGGGGSGGGGSGGGGSDIVMTQSPSSLSASIGDRVTITCRASHSISSYVNWYQKKPGKAPNLLIYAASYLPRGVPSRFSGSGLGTDFTLTISNLQPEDFATYYCQESYSTPYSFGQGTKVDIKR

SEQ ID NO: 6051 - protein, 244 aa, Artificial Sequence
  Description of Artificial Sequence: Synthetic single chain variable fragment sequence
QVQLVQSGAEVRKPGASVKVSCKTSGYTFIEYYIHWVRQAPGQGLEWMGWSNPVTGTSGSSPKFRGRVTLTTDTSGNTAYLDLRSLRSDDTAVFYCARRHQQSLDYWGRGTTVTVSSGGGGSGGGGSGGGGSAQSVLTQPPSVSAAPGQKVTISCSGTNSNIGNYYVSWYQQLPGTAPKLLIYDNNKRPSGVPDRFSGSKSGTSASLVISGLRSEDEADYYCAAWDGSLTAWVFGGGTKVTVLG

SEQ ID NO: 6052 - protein, 241 aa, Artificial Sequence
  Description of Artificial Sequence: Synthetic single chain variable fragment sequence
QVQLQESGGGVVQPGRSLRLSCAASGFTFSSYGMHWVRQAPGKGLEWVSAIGSSGGSTHDADTVKGRFTISRDNAKNSLYLQMNSLRAEDTAVYYCARDRARGFDYWGQGTLVTVSSGGGGGSGGGGSGGGGSEIVLTQSPSTLSASIGDRVTITCRASQGISSYLAWYQQKPGKAPKLLIYGASSLQSGVPSRFSGRGSGADFTLTISSLQPEDFATYYCQQLISYPLTFGGGTKVEIKR

SEQ ID NO: 6053 - protein, 250 aa, Artificial Sequence
  Description of Artificial Sequence: Synthetic single chain variable fragment sequence
QVQLQESGPGLVKPSGTLSLTCAVSGDSISSSNWWTWVRQPPGKGLEWIGEIFHSGTTNYNPSLNNRVTISLDESRNQFSLELSSVTAADTAIYYCARDSGNYDDNRGYDYWGRGTLVTVSSGGGGSGGGGSGGGGSAQSVLTQPPSVSGAPGQRVTISCAGTSSNIGAGFDVHWYQLLPGRAPKLLIYGNNNRPSGVPDRFSGSKSGTSASLAISGLQSEDEGDYYCAAWDDTVGGPVFGGGTKLTVLG

SEQ ID NO: 6054 - protein, 241 aa, Artificial Sequence
  Description of Artificial Sequence: Synthetic single chain variable fragment sequence
QVQLVQSGAEVKKPGASVKVSCKASGYTFTDYYMHWVRQAPGEGLEWMGWMNPNSGGTNYAQKFQGRVTMTRDTSISTAYMELSRLRSDDTAVYYCARSHYWDSWSPGTLVTVSSGGGGGSGGGGSGGGGSSALTQPASVSGSPGQSITISCTGTSGDVGGYNYVSWYQQHPGKAPKLMIYDVSNRPSGVSNRFSGSKSGNTASLTISGLQAEDEADYYCTSYAGSRNLVFGGGTKLTVLG

SEQ ID NO: 6055 - protein, 243 aa, Artificial Sequence
  Description of Artificial Sequence: Synthetic single chain variable fragment sequence
QVQLQESGGGLLQPGGSLRLSCAASRFTFSNYAMSWVRQAPGKGLEWVSAISGSGASTYYADSVKGRFTISRDNSKNTLYLQMNSLRAEDTAVYYCSNLYGDYDYWGQGTLVTVSSGGGGGSGGGGSGGGGSQSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVLG

SEQ ID NO: 6056 - protein, 240 aa, Artificial Sequence
  Description of Artificial Sequence: Synthetic single chain variable fragment sequence
QLQLQESGPGLVKPSGTLSLTCAVSGDSVSSYYWWSWVRQPPGKGLEWIGEIFRDGSSNYNRSLKSRVTISPDKPKNQFSLRLSSVTAADTAIYYCARHIRGYDAFDIWGRGTLVTVSSGGGGSGGGGSGGGGSAQSVLTQPPSVSGAPGQRVTISCTGSSSNIGAGYDVHWYQQFPGRAPKLLIYGNTNRPSGVPDRFSGSKSDISASLAITGLQAEDEADYYCQSYDSNLTGVFGGGT

SEQ ID NO: 6057 - protein, 255 aa, Artificial Sequence
  Description of Artificial Sequence: Synthetic single chain variable fragment sequence
QVQLQESGGGVVQPGGSLRLSCAASGFTFSSYSMNWVRQAPGKGLEWVSSISSSSSYIYYADSVKGRFTISRDNAKNSLYLQMNSLRAEDTAVYYCARDLPSDDYGDYDYYYYGMDVWGQGTTVTVSSGGGGGSGGGGSGGGGSQSVLTQPPSASGTPGQRVTLFCSGSSSNIASNSVKWYQQPPQRAPKLLMFSDDQRPSGVPVRFSASKSGTSASLAISGLQSEDEADYYCAAWDDSLNAEVFGGGTKVTVLG

SEQ ID NO: 6058 - protein, 251 aa, Artificial Sequence
  Description of Artificial Sequence: Synthetic single chain variable fragment sequence
QVQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGQGTTVTVSSGGGGSGGGGSGGGGSAQSALTQPASVSGSPGQSITISCTGTSSDVGGYNYVSWYQQHPGKAPKLMIYEVSNRPLGVSNRFSGSKSGNTASLTISGLQAEDEGDYYCSSYTSSTTLIVFGGGTKLTVLG

SEQ ID NO: 6059 - protein, 248 aa, Artificial Sequence
  Description of Artificial Sequence: Synthetic single chain variable fragment sequence
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSAQSVLTQPPSVSGTTGQRVILSCSGGNSNIGYNSVNWYQQLPGTAPKLLIYTDDQRPSGVPDRFSGSRSGTSASLAISGLQSEDEADYYCATWDDSLNAGVFGGGTKLTVLG

SEQ ID NO: 6060 - protein, 245 aa, Artificial Sequence
  Description of Artificial Sequence: Synthetic single chain variable fragment sequence
QVQLVQSGAEVRKPGASVRVSCKTSGYTFLEYYIHWVRQAPGQGLEWMAWSNPVTGTSGSSPKFRGRVTLTADTSGNTAYLDLKSLTSDDTAIFYCARRHQQSLDYWGQGTLVTVSSGGGGSGGGGSGGGGSAQSVLTQPPSVSAAPGQTVTISCSGSNSNIGNNHVSWYRQLPETAPKLLIYDNNKRPSGIPDRFSGSKSGTSATLDITGLQTGDEADYYCATWDNSLSAPWVFGGGTKLTVLG

SEQ ID NO: 6061 - protein, 245 aa, Artificial Sequence
  Description of Artificial Sequence: Synthetic single chain variable fragment sequence
QVQLQESGGGLVQPGGSLRLSCAASGFTFSNYAMSWVRQAPGKGLEWVSAISGSGGSTYYADSVKGRFTISRDNSKNTLYLQMNSLRAEDTAVYYCAKDRFRAAAYWGQGTLVTVSSGGGGGSGGGGSGGGGSQSVLTQPPSVSAAPGQKVTISCTGSSSNIGAGYDVHWYQQLPGTAPKLLIYGNSNRPSGVPDRFSGSKSGTSASLAISGLQSEDEADYYCAAWDDILNGEIFGGGTKVTVLG

SEQ ID NO: 6062 - protein, 252 aa, Artificial Sequence
  Description of Artificial Sequence: Synthetic single chain variable fragment sequence
QVQLQESGAEVKKPGSSVKVSCKASGGTFSSSAISWVRQAPGQGLEWMGGIIPVFGTANYAQKFQDRVTITADESTSTAYLELSRLTSEDTAVYYCASRGEYDYGDYDVYYYYMEVWGQGTLVTVSSGGGGSGGGGSGGGGSAQSVLTQPPSVSVAPGQTARLTCGANNIGSTSVHWYQQKPGQAPVLVIYDDTDRPSGIPERFSGSNSGNTATLTIRRVEAGDEADYYCQVWDTNSDHVIFGGGTKLTVLG

SEQ ID NO: 6063 - protein, 249 aa, Artificial Sequence
  Description of Artificial Sequence: Synthetic single chain variable fragment sequence
EVQLVQSGAEVKKPGSSVKVSCQASGGTFTSHAMYWVRQAPGQGLEWMGGIIPIFGRTNYAQKFQGRVTFTADMSTSTAYMEMTSLRSDDTAVYYCARGDNWNDLYPIDYWGRGTLVTVSSGGGGSGGGGSGGGGSALNFMLTQPHSVSESPGKTVTISCTRSSGSIATTYVQWFQQRPGSSPTTVIYDDDQRPSGVPDRFSGSIDSSSNSASLTISGLMPEDEADYYCQSYDNTDLVFGGGTQLTVLS

SEQ ID NO: 6064 - protein, 248 aa, Artificial Sequence
  Description of Artificial Sequence: Synthetic single chain variable fragment sequence
EVQLVQSGAEVKKPGASVKVSCKVSGYSLSELSMHWVRQAPGKGLEWMGGFDPQNGYTIYAQEFQGRITMTEDTSTDTVYMELGSLRSEDTAVYFCAAIEITGVNWYFDLWGKGTLVTVSSGGGGSGGGGSGGGGSALSSELTQDPDVSVALGQTVRITCQGDSLKKFYPGWYQQKPGQAPLLVLYGENIRPSRIPDRFSGSSSGNTATLTITGAQAEDEAVYYCNSREASVHHVRVFGGGTKLTVLG

SEQ ID NO: 6065 - protein, 251 aa, Artificial Sequence
  Description of Artificial Sequence: Synthetic single chain variable fragment sequence
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSALNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNQGVVFGGGTKLTVLG

SEQ ID NO: 6066 - protein, 251 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTGSSGSIASNYVQWYQQRPGSAPTTLIYEDDQRPSGVPDRFSGSVDSSSNSASLTISGLKTEDEADYYCQSYDRSNQAVVFGGGTKLTVLG

SEQ ID NO: 6067 - protein, 253 aa, Artificial Sequence
  Description of Artificial Sequence: Synthetic single chain variable fragment sequence
QVQLVQSGPEVKKPGASVEVSCKASGYTFTGDYMHWVRQAPGQGPEWMGWINPQTGVTKYAQKFQGRVTMARDTSINTAYMELRGLRSDDTAVYYCVREDHNYDLWSAYNGLDVWGQGTLVTVSSGGGGSGGGGSGGGGSAQSVLTQPPSVSAAPGQKVTISCSGSSSNIGNNHVSWYQQLAGTAPKLLIFDNDKRPSGIPDRFSGSKSGTSATLGITGLQTGDEADYYCGTWDKSPTDIYVFGSGTKLTVLG

SEQ ID NO: 6068 - protein, 247 aa, Artificial Sequence
  Description of Artificial Sequence: Synthetic single chain variable fragment sequence
QVQLQESGPGLVKPSGTLSLTCAVSGGSISSSNWWSWVRQAPGKGLEWIGEIYYGGSTNYNPSLKSRVTLSVDKSKNQFSLRLISVTAADTAVYYCARSSGLYGDYGNLWGRGTLVTVSSGGGGSGGGGSGGGGSAQSVVTQPPSVSAAPGQKVTISCSGSASNIGDHYISWYQQFPGTAPKLLISDNDQRPSGIPDRFSGSKSGTSATLGITGLQTGDEADYYCGTWDSNLSSWVFGSGTKVTVLG

SEQ ID NO: 6069 - protein, 244 aa, Artificial Sequence
  Description of Artificial Sequence: Synthetic single chain variable fragment sequence
QVQLVQSGAEVRKPGASVKVSCKTSGYTFMDYYIHWVRQAPGQGLEWMGWSNPVTGTSGSSPKFRGRVTLTTDTSGNTAYLDLRSLRSDDTAVFYCARRHQQSLDYWGQGTMVTVSSGGGGSGGGGSGGGGSAQSVLTQPPSVSAAPGQKVTISCSGSSSNIGNNYVSWYQQLPGTAPKLLMYENSKRPSGIPDRFSGSKSGTSGTLGITGLQTGDEADYYCGTWDTSLRAWVFGGGTKVTVLG

SEQ ID NO: 6070 - protein, 250 aa, Artificial Sequence
  Description of Artificial Sequence: Synthetic single chain variable fragment sequence
EVQLVQSGAEVKKPGATLKVSCKVSAYTFTDYSMHWVQQAPGKGLKWMGLIDLEDGNTIYAEEFQDRVTITADTSTDTAYMDLSSLRSEDTAVFYCAISPLRGLTADVFDVWGQGTLVTVSSGGGGSGGGGSGGGGSAQSALTQPASASGSPGQSITISCTGTSSDIGRYDFVSWYQRQPGKAPKLMIYDVINRPSGVSSRFSGSKSGNTASLTISGLQAEDEADYYCSSYAGSTTLYVFGTGTKLTVLG

SEQ ID NO: 6071 - protein, 246 aa, Artificial Sequence
  Description of Artificial Sequence: Synthetic single chain variable fragment sequence
QVQLQESGPGLVKPSATLSLTCAVSGGSISSNHWWSWVRQSPGKGLEWIGEIYTYGGANYNPSLKSRVDISMDKSKNQFSLHLSSVTAADTAVYYCGRHLTGYDCFDIWGQGTLVTVSSGGGGSGGGGSGGGGSAQAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGTGTQLTVLS

SEQ ID NO: 6072 - protein, 249 aa, Artificial Sequence
  Description of Artificial Sequence: Synthetic single chain variable fragment sequence
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTRSSGSIASKYVQWYQQRPGSAPTSVIYEDNQRPSGVPDRFSGSIDSASNSASLTISGLKTEDEADYYCQSDDGSSVVFGGGTKVTVLG

SEQ ID NO: 6073 - protein, 257 aa, Artificial Sequence
  Description of Artificial Sequence: Synthetic single chain variable fragment sequence
EVQLVQSGAEVKKPGASVKVSCKASGYSFPSSGLSWVRQAPGQGPEWMGWIGIYNGNTDYAQKFQGRVTMTTDKSTSTAYMELRSLRSDDTAVYYCARDSVGSISVAGTMQYYYFAMDVWGQGTLVTVSSGGGGSGGGGSGGGGSAQSVLTQPPSASGSPGQSVTISCAGTRYDIGTYNYVSWYQQHPAKGPKLIIYAVSERPSGVPNRFSGSKSGNTASLTVSGLRAEDEAHYYCSSYAGNNNVIFGGGTKVTVLG

SEQ ID NO: 6074 - protein, 247 aa, Artificial Sequence
  Description of Artificial Sequence: Synthetic single chain variable fragment sequence
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTMVTVSSGGGGSGGGGSGGGGSAQSVLTQPPSASGTPGQRVTISCSGSFSNIGGNYVNWYQQLPGTAPKLLIYGNNQRPSGVPDRFSSFKSGTSASLAISGLRSEDEADYYCATWDDSQTVLFGGGTKLTVLG

SEQ ID NO: 6075 - protein, 251 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGKGTLVTVSSGGGGSGGGGSGGGGSALNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPYVVFGGGTKLTVLG

SEQ ID NO: 6076 - protein, 251 aa, Artificial Sequence
  Description of Artificial Sequence: Synthetic single chain variable fragment sequence
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSGSPGRTVTISCTRSSGSIATNYVQWYQQRPGSSPTIVIYEDNQRPSGVPDRFSGSIDTSSNSASLTISGLKTEDEADYYCQSYDSNNLGVVFGGGTQLTVLS

SEQ ID NO: 6077 - protein, 244 aa, Artificial Sequence
  Description of Artificial Sequence: Synthetic single chain variable fragment sequence
QVQLQQSGAEVRKPGASAKVSCKTSGYTFIDYYIHWVRQAPGQGLEWMGWINPVTGASGSSPNFRGRVTLTTDTSGNTAYMELRSLRSDDTAVFYCARRHQQSLDYWGRGTTVTVSSGGGGSGGGGSGGGGSAQSVVTQPPSVSAAPGQKVTISCSGRTSNIGNNYVSWYQQVPGAPPKLLIFDNNKRPSGTPARFSGSKSGTSATLAISGLQTGDEADYYCGTWDTTLRGFVFGPGTKVTVLG

SEQ ID NO: 6078 - protein, 248 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSAQSVVTQPPSVSAAPGQKVTISCSGSSSNIGNNYVSWYKQLPGTAPKLLIYDNNKRPSGIPDRFSGSKSGTSATLGITGLQTGDEADYYCGTWDSSLSGVVFGGGTKLTVLG

SEQ ID NO: 6079 - protein, 251 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTVTISCTRSSGSIASNYVQWYQQRPGSSPTTLIYDDNQRPSGVPDRFSGSIDSSSNSASLTISGLKTEDEADYYCQSYDSSNLGVVFGGGTKLTVLG

SEQ ID NO: 6080 - protein, 250 aa, Artificial Sequence
  Description of Artificial Sequence: Synthetic single chain variable fragment sequence
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTATISCTGSGGSIARSYVQWYQQRPGRAPSIVIYEDYQRPSGVPDRFSGSIDSSSNSASLTITGLKTDDEADYYCQSSDDNNNVVFGGGTKVTVLG

SEQ ID NO: 6081 - protein, 248 aa, Artificial Sequence
  Description of Artificial Sequence: Synthetic single chain variable fragment sequence
QVQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQAVLTQPSSVSAAPGQKVTISCSGSSSNIGNNYVSWYQQLPGTAPKLLIYDNNERPSGIPDRFSGSKSGTSATLGITGLQTGDEADYYCGTWDSSLSTVVFGTGTKVTVLG

SEQ ID NO: 6082 - protein, 249 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTVSCTGSGGNIASNYVQWYQQRPDSAPTLVIFEDTQRPSGVPARFSGSIDSSSNSASLIISSLRTEDEADYYCQSSDSNRVVFGGGTKVTVLG

SEQ ID NO: 6083 - protein, 241 aa, Artificial Sequence
  Description of Artificial Sequence: Synthetic single chain variable fragment sequence
QVQLQESGPGLVKPSETLSLTCNVSGGSIRNYFWSWIRQPPGQGLEYIGYIYYSGTTDYNPSLKGRVTISLDTSKTQFSLKLNSVTAADTAFYYCVRGPNKYAFDPWGQGTLVTVSSGGGGSGGGGSGGGGSALSYELTQPPSVSVSPGQTASITCSGDKLGDKFASWYQQKAGQSPVLVIYRDTKRPSGIPERFSGSNSGNTATLTISGTQAMDEADYYCQAWDSSTAVFGTGTKVTVLG

SEQ ID NO: 6084 - protein, 251 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGQGTLVTVSSGGGGSGGGGSGGGGSALNFMLTQPHSVSESPGKTVTISCTRSSGSIDNNYVQWYQQRPGSSPTTVIFEDNQRPSGVPDRFSGSIDSSSNSASLTISGLKTEDEADYYCQSYDSHNQGVVFGGGTKLTVLG

SEQ ID NO: 6085 - protein, 248 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQSVLTQPPSVSAAPGQKVTISCSGSSSNIGNSYVSWYKQLPGTAPKVLIYDNQKRSSGIPDRFSASKSGTSATLGITGLRTEDEADYYCGTWDTSLSAVVFGGGTKLTVLG

SEQ ID NO: 6086 - protein, 248 aa, Artificial Sequence
  Description of Artificial Sequence: Synthetic single chain variable fragment sequence
EVQLVESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSAQSVVTQPPSVSAAPGQKVTISCSGNFSNIEYNYVSWYQHLPGTAPKLLIFDNNQRPSWIPDRFSGSKSGTSATLGITGLQTGDEADYYCGTWDSSLNAGVFGGGTKVTVLG

SEQ ID NO: 6087 - protein, 250 aa, Artificial Sequence
  Description of Artificial Sequence: Synthetic single chain variable fragment sequence
QLQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGRGTLVTVSSGGGGSGGGGSGGGGSAQSALTQPPSASGSPGQSVTISCSGSSSDIGDYNHVSWYQQHPGKAPKLMIYDVNKWPSGVPDRFSGSKSGNTASLTVSGLQAEDEADYYCSSYSGIYNLVFGGGTKVTVLG

SEQ ID NO: 6088 - protein, 250 aa, Artificial Sequence
  Description of Artificial Sequence: Synthetic single chain variable fragment sequence
QLQLQESGPGLVKPSGTLSLTCAVSGGSISTSDWWSWVRRPPGKGLEWIGEIYHSGSTNYHPSLKSRVTISLDKSKNQFSLKLSSVTAADTAVYYCAREGGHSGSYPLDYWGRGTLVTVSSGGGGSGGGGSGGGGSALNFMLTQPHSVSESPGKTVTISCARSSGSIASNYVQWYQQRPGSSPTTLIYEDRQRPSGVPDRFSGSIDSSSNSASLTISGLKTEDEADYYCQSYDSSDHVVFGGGTKLTVLG

SEQ ID NO: 6089 - protein, 251 aa, Artificial Sequence
  Description of Artificial Sequence: Synthetic single chain variable fragment sequence
EVQLVQSGAEVKKPGSSVKVSCKASGGTFKTYAINWVRQAPGQGLEWMGGIIPVLGTANYVQKFQGRVTITADESTTTAYMELRGLRSEDTAVYYCARGEGSGWYDHYYGLDVWGQGTLVTVSSGGGGSGGGGSGGGGSAQSVLTQPPSASGTPGQRVTISCSGSSSNIGSNTVNWYRQLPGTAPKLLIFGDDQRPSGVPDRFSGSRSGTSVSLAISGLQSEDEADYYCAAWDDSLNGGVFGGGTKLTVLG

SEQ ID NO: 6090 - protein, 242 aa, Artificial Sequence
  Description of Artificial Sequence: Synthetic single chain variable fragment sequence
KVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDVRNAFDIWGRGTTVTVSSGGGGSGGGGSGGGGSAQSVLTQPPSVSVSPGQTTSITCSRDKLGEQYVYWYQQRPGQSPILLLYQDSRRPSWIPERFSGSNSGDTATLTISGTQALDEADYYCQAWDNSSYVAFGGGTKVTVLG

SEQ ID NO: 6091 - protein, 250 aa, Artificial Sequence
  Description of Artificial Sequence: Synthetic single chain variable fragment sequence
QVQLQESGPGLVKPSGTLSLTCAVSGGSISSTNWWSWVRQPPGKGLEWIGEIYHSGSTNYNPSLKSRVTISVDKSKNHFSLNLSSVTAADTAVYYCARDSMGSTGWHYGMDLWGRGTLVTVSSGGGGSGGGGSGGGGSAQSALTQPAAVSGSPGQSITISCTGSSSDVGGYNYVSWYQQHPGKAPKLLIYDVSDRPSGVSYRFSGSKSGNTASLTISGLQAEDEADYYCSSYTATGTLVFGGGTKLTVLG

SEQ ID NO: 6092 - protein, 243 aa, Artificial Sequence
  Description of Artificial Sequence: Synthetic single chain variable fragment sequence
EVQLVESGGGLVQPGGSLRLSCAASGFDFSRYWMSWVRQAPGKGLEWIGEINPDSSTINYAPSLKDKFIISRDNAKSLYLQMNSLRAEDTAVYYCARPDGNYWYFDVWGQGTLVTVSSGSTSGGGSGGGSGGGGSSDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIK

SEQ ID NO: 6093 - protein, 242 aa, Artificial Sequence; identical to SEQ ID NO: 5998
  Description of Artificial Sequence: Synthetic single chain variable fragment sequence

SEQ ID NO: 6094 - protein, 259 aa, Artificial Sequence
  Description of Artificial Sequence: Synthetic single chain variable fragment sequence
MEFGLSWLFLVAILKGVQCSRMAQVKLKESGPELKKPGETVKISCKASGYTFTDYSMHWVKKTPGKGLKWLGWINTATGEPTYADDFKGRFAISLETSARTVYLQINNLRNEDTATYFCFSYYDYWGQGTTVTVSSGGGGSGGGGSGGGGLDIKLTQSPSILSVTPGETVSLSCRASQTIYKNLHWYQQKSHRSPRLLIKYGSDSISGIPSRFTGSGSGTDYTLNINSVKPEDEGIYYCLQGYSTPWTFGGGTKLEIKR

SEQ ID NO: 6095 - protein, 259 aa, Artificial Sequence; identical to SEQ ID NO: 6094
  Description of Artificial Sequence: Synthetic single chain variable fragment sequence

SEQ ID NO: 6096 - protein, 450 aa, Artificial Sequence
  Description of Artificial Sequence: Synthetic single chain variable fragment sequence
EVQLVESGGGLVQPGRSLRLSCTASGFTFTDNYMSWVRQAPGKGLEWVGFIRNKANGYTTEYAASVKGRFTISRDDSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6097 - protein, 450 aa, Artificial Sequence
  Description of Artificial Sequence: Synthetic single chain variable fragment sequence
EVQLVESGGGLVQPGRSLRLSCTASGFTFTDNYMSWVRQAPGKGLEWLGFIRNKANGYTTEYAASVKGRFTISRDNSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6098 - protein, 450 aa, Artificial Sequence
  Description of Artificial Sequence: Synthetic single chain variable fragment sequence
EVNLVESGGGLVQPGRSLRLSCTASGFTFTDNYMSWVRQAPGKGLEWLGFIRNKANGYTTDYAASVRGRFTISRDNSKSILYLQMNALRTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6099 - protein, 219 aa, Artificial Sequence
  Description of Artificial Sequence: Synthetic single chain variable fragment sequence
DIVMTQSPSSLAVSLGERATMSCKSSQSLFNSRTRKNYLAWYQQKPGQSPKLLIYWASARDSGVPARFTGSGSETYFTLTISRVQAEDLAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6100 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYRGDVWGQGTLVTVSS

SEQ ID NO: 6101 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCLRAPQSWYVGDVWGQGTLVTVSS

SEQ ID NO: 6102 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETMSLTCAVYGGSFSGYYWSWIRQPPGKGLEWIGEINHSGSTNYNPSLKSRVTISVDTSKNQFSLKLSSVTAADTAVYYCARAPQSWYRGDVWGQGTLVTVSS

SEQ ID NO: 6103 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCATWDENPKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 6104 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCATWEDNRKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 6105 - protein, 250 aa, Artificial Sequence
  Description of Artificial Sequence: Synthetic single chain variable fragment sequence
SYELTQPPSVSGTPGQRVAISCSGSSSNIGTRVVTWYQHVPGTAPKLLIFNNNQRPSGVPDRFSASKSGTSASLAIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 6106 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 6107 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNPKSYHFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 6108 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLTIIGLQSDDEADYYCAAWDDNLKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTMSVDTSKRQFSLKLSSVTAADTAVYYCARAPQSWYVGDVWGQGTLVTVSS

SEQ ID NO: 6109 - protein, 250 aa, Artificial Sequence
  Description of Artificial Sequence: Synthetic single chain variable fragment sequence
SYELTQPPSVSGTPGQRVAISCSGSSSNIGTRMVTWYQHVPGTAPKLLIFNNNQRPSGVPDRFSASKSGTSASLAIIGLQSDDEADYYCAAWDDNLKSYVFGTGTKVTVLGSRGGGGSGGGGSDGGGSLEMAQVQLQQWGAGLLKPSETLSLTCAVYGGSFSGYYWSWIRQLPGKGLEWIGEINHSGSTNYNPYLKSRVTISVDTSKRQFSLKLSSVTAADTAVYYCARAPQSWYVGDVWGQGTLVTVSS

SEQ ID NO: 6110 - protein, 227 aa, Artificial Sequence
  Description of Artificial Sequence: Synthetic single chain variable fragment sequence
SVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 6111 - protein, 246 aa, Artificial Sequence
  Description of Artificial Sequence: Synthetic single chain variable fragment sequence
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 6112 - protein, 277 aa, Artificial Sequence
  Description of Artificial Sequence: Synthetic single chain variable fragment sequence
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHH

SEQ ID NO: 6113 - protein, 246 aa, Artificial Sequence
  Description of Artificial Sequence: Synthetic single chain variable fragment sequence
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 6114 - protein, 261 aa, Artificial Sequence
  Description of Artificial Sequence: Synthetic single chain variable fragment sequence
HAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 6115 - protein, 246 aa, Artificial Sequence
  Description of Artificial Sequence: Synthetic single chain variable fragment sequence
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 6116 - protein, 277 aa, Artificial Sequence
  Description of Artificial Sequence: Synthetic single chain variable fragment sequence
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 6117 - protein, 246 aa, Artificial Sequence
  Description of Artificial Sequence: Synthetic single chain variable fragment sequence
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 6118 - protein, 277 aa, Artificial Sequence
  Description of Artificial Sequence: Synthetic single chain variable fragment sequence
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHH

SEQ ID NO: 6119 - protein, 246 aa, Artificial Sequence
  Description of Artificial Sequence: Synthetic single chain variable fragment sequence
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 6120 - protein, 277 aa, Artificial Sequence
  Description of Artificial Sequence: Synthetic single chain variable fragment sequence
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 6121 - protein, 246 aa, Artificial Sequence
  Description of Artificial Sequence: Synthetic single chain variable fragment sequence
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 6122 - protein, 278 aa, Artificial Sequence
  Description of Artificial Sequence: Synthetic single chain variable fragment sequence
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHHH

SEQ ID NO: 6123 - protein, 246 aa, Artificial Sequence
  Description of Artificial Sequence: Synthetic single chain variable fragment sequence
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 6124 - protein, 278 aa, Artificial Sequence
  Description of Artificial Sequence: Synthetic single chain variable fragment sequence
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHHH

SEQ ID NO: 6125 - protein, 246 aa, Artificial Sequence
  Description of Artificial Sequence: Synthetic single chain variable fragment sequence
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 6126 - protein, 277 aa, Artificial Sequence
  Description of Artificial Sequence: Synthetic single chain variable fragment sequence
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 6127 - protein, 274 aa, Artificial Sequence
  Description of Artificial Sequence: Synthetic single chain variable fragment sequence
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKGSHHHHHHHH

SEQ ID NO: 6128 - protein, 240 aa, Artificial Sequence
  Description of Artificial Sequence: Synthetic single chain variable fragment sequence
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 6129 - protein, 269 aa, Artificial Sequence
  Description of Artificial Sequence: Synthetic single chain variable fragment sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSHHHHHHHH

SEQ ID NO: 6130 - protein, 249 aa, Artificial Sequence
  Description of Artificial Sequence: Synthetic single chain variable fragment sequence
SYELTQPPSVSVAPGQTARITCSGDALGDKYASWYQQKPGQAPVLVIYEDSKRPSGIPERFSGSNSGNTATLTISGTQAEDEADYYCSVWDGDWGMPVFGGGTKLTVLGSGGSTITSYNVYYTKLSSSGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGIIYPSNVAVWGQGTLVTVSS

SEQ ID NO: 6131 - protein, 126 aa, Artificial Sequence
  Description of Artificial Sequence: Synthetic single chain variable fragment sequence
EAQLVQSGAEGKKPGSSVKVSCKAPGGTFNSYAISWVRQAPGQGLEWMGGIIPIFGTAYYAQKFQGRVTITADESTSTAYMELSSLRSEDTAVYYCAREEGPYCSSTSCYAAFDIWGRGTLVTVSS

SEQ ID NO: 6132 - protein, 126 aa, Artificial Sequence
  Description of Artificial Sequence: Synthetic single chain variable fragment sequence
EAQLVQSGAEGKKPGSSVKVSCKAPGGTFNSYAISWVRQAPGQGLEWMGGIIPIFGTAYYAQKFQGRVTITADESTSTAYMELSSLRSEDTAVYYCAREEGPYCSSTSCYGAFDIWGRGTLVTVSS

SEQ ID NO: 6133 - protein, 126 aa, Artificial Sequence
  Description of Artificial Sequence: Synthetic single chain variable fragment sequence
EVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSS

SEQ ID NO: 6134 - protein, 126 aa, Artificial Sequence
  Description of Artificial Sequence: Synthetic single chain variable fragment sequence
EVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYGAFDIWGQGTLVTVSS

SEQ ID NO: 6135 - protein, 126 aa, Artificial Sequence
  Description of Artificial Sequence: Synthetic single chain variable fragment sequence
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEGPYCSSTSCYAAFDIWGQGTLVTVSS

SEQ ID NO: 6136 - protein, 126 aa, Artificial Sequence
  Description of Artificial Sequence: Synthetic single chain variable fragment sequence
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEGPYCSSTSCYGAFDIWGQGTLVTVSS

SEQ ID NO: 6137 - protein, 126 aa, Artificial Sequence
  Description of Artificial Sequence: Synthetic single chain variable fragment sequence
EVQLVQSGAEVKKPGSSVKVSCKASGGTFSSYAISWVRQAPGQGLEWVGGIIPIFGTANYAQKFQGRVKITADESASTAYMELSSLRSEDTAVYYCAREEGPYCSSTSCYAAFDIWGQGTLVTVSS

SEQ ID NO: 6138 - protein, 126 aa, Artificial Sequence
  Description of Artificial Sequence: Synthetic single chain variable fragment sequence
EVQLVQSGAEVKKPGSSVKVSCKASGGTFSSYAISWVRQAPGQGLEWVGGIIPIFGTANYAQKFQGRVKITADESASTAYMELSSLRSEDTAVYYCAREEGPYCSSTSCYGAFDIWGQGTLVTVSS

SEQ ID NO: 6139 - protein, 126 aa, Artificial Sequence
  Description of Artificial Sequence: Synthetic single chain variable fragment sequence
EVQLVQSGAEVKKLGSSVKVSCKASGGTFSSYAISWVRQAPGQGLEWVGGIIPIFGTANYAQKFQGRVKITADESASTAYMELSSLRSEDTAVYYCAREEGPYCSSTSCYGAFDIWGQGTLVTVSS

SEQ ID NO: 6140 - protein, 108 aa, Artificial Sequence
  Description of Artificial Sequence: Synthetic single chain variable fragment sequence
QSVLTQDPAASVALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 6141 - protein, 108 aa, Artificial Sequence
  Description of Artificial Sequence: Synthetic single chain variable fragment sequence
QSVLTQDPAVSAALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 6142 - protein, 108 aa, Artificial Sequence
  Description of Artificial Sequence: Synthetic single chain variable fragment sequence
QSVLTQDPAVSVALGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 6143 - protein, 108 aa, Artificial Sequence
  Description of Artificial Sequence: Synthetic single chain variable fragment sequence
QSVLTQDPAVSVALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 6144 - protein, 108 aa, Artificial Sequence
  Description of Artificial Sequence: Synthetic single chain variable fragment sequence
QSVLTQDPAVSVALGQTVKITCQGDSLRSYLASWYQQKPGQAPTLVTYARNDRPAGVPDRFSGSKSGTSASLAISGLQSEDEADYYCAAWDDSLNGYLFGAGTKLTVL

SEQ ID NO: 6145 - protein, 363 aa, Artificial Sequence
  Description of Artificial Sequence: Synthetic single chain variable fragment sequence
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCGFSASPAFFQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 6146 - protein, 232 aa, Artificial Sequence
  Description of Artificial Sequence: Synthetic single chain variable fragment sequence
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 6147 - protein, 353 aa, Artificial Sequence
  Description of Artificial Sequence: Synthetic single chain variable fragment sequence
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 6148 - protein, 222 aa, Artificial Sequence
  Description of Artificial Sequence: Synthetic single chain variable fragment sequence
MATGSRTSLLLAFGLLCLPWLQEGSADILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 6149 - protein, 616 aa, Artificial Sequence
  Description of Artificial Sequence: Synthetic single chain variable fragment sequence
MATGSRTSLLLAFGLLCLPWLQEGSADIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKGGGGSGGGGSGGGGSEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 6150 - protein, 658 aa, Artificial Sequence
  Description of Artificial Sequence: Synthetic single chain variable fragment sequence
MATGSRTSLLLAFGLLCLPWLQEGSAEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSGGGGSGGGGSGGGGSDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRSKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 6151 - protein, 616 aa, Artificial Sequence
  Description of Artificial Sequence: Synthetic single chain variable fragment sequence
MATGSRTSLLLAFGLLCLPWLQEGSAEVQLVQSGAEVKKPGASVKVSCKASGDTFTTYVIHWMRQAPGQGLEWIGYINPYNDGTKYNEKFKGRVTITSDKSTSTAYMELSSLRSEDTAVYYCARIYYDYDGDYWGQGTLVTVSSGGGGSGGGGSGGGGSDIQMTQSPSSLSASVGDRVTITCITSNDIDDDMNWYQQKPGKAPKLLISEGNTLRPGVPSRFSGSGYGTDFTLTISSLQPEDVATYYCFQSDNLPYTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTCGGGGSGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 6152 - protein, 359 aa, Artificial Sequence
  Description of Artificial Sequence: Synthetic single chain variable fragment sequence
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSGGGGSGGGGSGGGGSDIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 6153 - protein, 418 aa, Artificial Sequence
  Description of Artificial Sequence: Synthetic single chain variable fragment sequence
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSGGGGSGGGGSGGGGSDIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 6154 - protein, 278 aa, Artificial Sequence
  Description of Artificial Sequence: Synthetic single chain variable fragment sequence
MATGSRTSLLLAFGLLCLPWLQEGSASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 6155 - protein, 412 aa, Artificial Sequence
  Description of Artificial Sequence: Synthetic single chain variable fragment sequence
MATGSRTSLLLAFGLLCLPWLQEGSASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 6156 - protein, 330 aa, Artificial Sequence
  Description of Artificial Sequence: Synthetic single chain variable fragment sequence
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGGSGGGGSGGGGSDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 6157 - protein, 262 aa, Artificial Sequence
  Description of Artificial Sequence: Synthetic single chain variable fragment sequence
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 6158 - protein, 243 aa, Artificial Sequence
  Description of Artificial Sequence: Synthetic single chain variable fragment sequence
EIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 6159 - protein, 246 aa, Artificial Sequence; identical to SEQ ID NO: 6111
  Description of Artificial Sequence: Synthetic single chain variable fragment sequence

SEQ ID NO: 6160 - protein, 262 aa, Artificial Sequence; identical to SEQ ID NO: 6157
  Description of Artificial Sequence: Synthetic single chain variable fragment sequence

SEQ ID NO: 6161 - protein, 240 aa, Artificial Sequence
  Description of Artificial Sequence: Synthetic single chain variable fragment sequence
MKYLLPTAAAGLLLLAASGAHAQVQLVQSGGGLVKPGGSLRLSCAASGFTFSSYSMNWVRQAPGKGLEWVANIKPDGSERHSVDSVKGRFTISRDNSKNSLYLQMNSLRAEDTAVYYCARPGAGRLDYWGQGTLVTVSSGGGGSGGGGSGGGGSNFMLTQDAAVSVALGQTVRITCQGDSLRSYYASWYQQKPGQAPVLVVYGKNNRPSGIPDRFSGSSSGNTASLTITGAQAEDEADYY

SEQ ID NO: 6162 - protein, 248 aa, Artificial Sequence
  Description of Artificial Sequence: Synthetic single chain variable fragment sequence
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTGGGGSGGGGSGGGGSQSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLG

SEQ ID NO: 6163 - protein, 255 aa, Artificial Sequence
  Description of Artificial Sequence: Synthetic single chain variable fragment sequence
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSSGGGGSSGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLG

SEQ ID NO: 6164 - protein, 246 aa, Artificial Sequence
  Description of Artificial Sequence: Synthetic single chain variable fragment sequence
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSSGGGGSGGGGSGGGGSQSVLTQPPSVSGAPGQRVTISCTGSSSNIGAGYGVHWYQQLPGTAPKLLIYGNTNRPSGVPDRFSGFKSGTSASLAITGLQAEDEADYYCQSYDSSLSGWVFGGGTKLTVLG

SEQ ID NO: 6165 - protein, 242 aa, Artificial Sequence
  Description of Artificial Sequence: Synthetic single chain variable fragment sequence
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSSGGGGSGGGGSGGGGSETTLTQSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIKR

SEQ ID NO: 6166 - protein, 241 aa, Artificial Sequence
  Description of Artificial Sequence: Synthetic single chain variable fragment sequence
EVQLLESGGGLVQPGGSLRLSCAASGFTFSSYAMSWVRQAPGKGLEWVSQIDPWGQETLYADSVKGRFTISRDNSKNTLYLQMNSLRAEDTAVYYCAKLTGRFDYWGQGTLVTVSSGGGGSGGGGSGGGGSTDIQMTQSPSSLSASVGDRVTITCRASQSISSYLNWYQQKPGKAPKLLIYSASQLQSGVPSRFSGSGSGTDFTLTISSLQPEDFATYYCQQGPGTPNTFGQGTKVEIKRA

SEQ ID NO: 6167 - protein, 275 aa, Artificial Sequence
  Description of Artificial Sequence: Synthetic single chain variable fragment sequence
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLGSRGGGGSGGGGSGGGGSLEMAEVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSSTSGQAGQHHHHHHGAYPYDVPDYAS

SEQ ID NO: 6168 - protein, 273 aa, Artificial Sequence
  Description of Artificial Sequence: Synthetic single chain variable fragment sequence
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAEVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSSTSGQAGQHHHHHHGAYPYDVPDYAS

SEQ ID NO: 6169 - protein, 271 aa, Artificial Sequence
  Description of Artificial Sequence: Synthetic single chain variable fragment sequence
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLGSRGGGGSGGGGSGGGGSLEMAQVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSSTSGQAGQHHHHHHGAYPYDVPDYAS

SEQ ID NO: 6170 - protein, 276 aa, Artificial Sequence
  Description of Artificial Sequence: Synthetic single chain variable fragment sequence
QSALTQPASVSGSPGQSMSCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSSTSGQAGQHHHHHHGAYPYDVPDYAS

SEQ ID NO: 6171 - protein, 277 aa, Artificial Sequence
  Description of Artificial Sequence: Synthetic single chain variable fragment sequence
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSSTSGQAGQHHHHHHGAYPYDVPDYAS

SEQ ID NO: 6172 - protein, 272 aa, Artificial Sequence
  Description of Artificial Sequence: Synthetic single chain variable fragment sequence
QSALTQPASVSGSPGQSMSCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSSTSGQAGQHHHHHHGAYPYDVPDYAS

SEQ ID NO: 6173 - protein, 274 aa, Artificial Sequence
  Description of Artificial Sequence: Synthetic single chain variable fragment sequence
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSSTSGQAGQHHHHHHGAYPYDVPDYAS

SEQ ID NO: 6174 - protein, 274 aa, Artificial Sequence
  Description of Artificial Sequence: Synthetic single chain variable fragment sequence
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLGSRGGGGSGGGGSGGGGSLEMAQMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSSTSGQAGQHHHHHHGAYPYDVPDYAS

SEQ ID NO: 6175 - protein, 274 aa, Artificial Sequence
  Description of Artificial Sequence: Synthetic single chain variable fragment sequence
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSSTSGQAGQHHHHHHGAYPYDVPDYAS

SEQ ID NO: 6176 - protein, 276 aa, Artificial Sequence
  Description of Artificial Sequence: Synthetic single chain variable fragment sequence
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLGSRGGGGSGGGGSGGGGSLEMAEVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSSTSGQAGQHHHHHHGAYPYDVPDYAS

SEQ ID NO: 6177 - protein, 274 aa, Artificial Sequence
  Description of Artificial Sequence: Synthetic single chain variable fragment sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLGSRGGGGSGGGGSGGGGSLEMAQVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSSTSGQAGQHHHHHHGAYPYDVPDYAS

SEQ ID NO: 6178 - protein, 249 aa, Artificial Sequence
  Description of Artificial Sequence: Synthetic single chain variable fragment sequence
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGPYDGFDSWGQGTLVTVSS

SEQ ID NO: 6179 - protein, 249 aa, Artificial Sequence
  Description of Artificial Sequence: Synthetic single chain variable fragment sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSVVFGGGTKLTVLGSRGGGGSGGGGSGGGGSLEMAQVQLVQSGTEVKKPGASVRVACKASGYPFNKYDINWVRQAPGQGLEWMGGIIPIFRTTNYAQKFQGRVTITADESTSTAYMELSSLRSEDTAVYYCAREWFYWDIWGQGTLVTVSS

SEQ ID NO: 6180 - protein, 250 aa, Artificial Sequence
  Description of Artificial Sequence: Synthetic single chain variable fragment sequence
QSVLTQPPSVSVSPGQTASISCSGNKLGTKYVYWYQKRPGQSPVLVMYEDNQRPSGIPERFSGSNSGNTATLTIRGTQTVDEADYYCQAWDSDTFVVFGGGTKVTVLGSRGGGGSGGGGSGGGGSLEMAEVQLVETGGGVVQPGRSLRLSCAASGFTFSSYGMHWVRQAPGKGLEWVAVISHDGSNKYYADSVKGRFTISRDNSKDTLYLQMNSLRGEDTAVYYCARSNQWSGYFSFDYWGQGTLVTVSS

SEQ ID NO: 6181 - protein, 248 aa, Artificial Sequence
  Description of Artificial Sequence: Synthetic single chain variable fragment sequence
SYVLTQPPSVSVAPGKTARITCGGNNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAEVQLVQSGAEVKKPGASVKVSCKASGYTFTTYGISWVRQAPGQGLEWMGWINTYNGHTNYAQKLQGRATMTADTSTNTAYMELRSLRSDDTAVYYCARVIYGSGDYWGQGTLVTVSS

SEQ ID NO: 6182 - protein, 246 aa, Artificial Sequence
  Description of Artificial Sequence: Synthetic single chain variable fragment sequence
SYVLTQPLSVSVAPGKTARITCGGNNIGSKTVHWYQQKPGQAPVLVIYYDSDRPSGIPERFSGSNSGNTATLTISRVEAGDEADYYCQVWDSSSDHRVFGGGTKLTVLGSRGGGGSGGGGSGGGGSLEMAQVQLQESGPGLVKPSETLSLTCNVSGYSISSGYFWGWIRQPPGKGLEWIGSIYHSRSTYYNPSLKSRVTISVDTSKNQFSLKLNSVTAADTAVYYCARGYGYFDYWGQGTLVTVSS

SEQ ID NO: 6183 - protein, 253 aa, Artificial Sequence
  Description of Artificial Sequence: Synthetic single chain variable fragment sequence
QSALTQPASVSGSPGQSRRISCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSS

SEQ ID NO: 6184 - protein, 252 aa, Artificial Sequence
  Description of Artificial Sequence: Synthetic single chain variable fragment sequence
QSVLTQPPSASGTPGQTVTISCSGSNSNIGSNYVYWYQQLPGTAPKLLIYRNNQRPSGVPDRFSGSKSGTSASLAISGLRSEDEADYYCAAWDDSLSAYVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSGNMVSWKDMWGQGTLVTVSS

SEQ ID NO: 6185 - protein, 249 aa, Artificial Sequence
  Description of Artificial Sequence: Synthetic single chain variable fragment sequence
QSALTQPASVSGSPGQSRRISCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSS

SEQ ID NO: 6186 - protein, 250 aa, Artificial Sequence
  Description of Artificial Sequence: Synthetic single chain variable fragment sequence
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGSRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSS

SEQ ID NO: 6187 - protein, 249 aa, Artificial Sequence
  Description of Artificial Sequence: Synthetic single chain variable fragment sequence
QSVLTQPPSVSAAAGQKVTISCSGSDSNIGNNYVSWYQHLPGTAPKLLIYDVKNRPSGIPDRFSGSKSGSSATLGIAGLQPGDEADYYCGTWDSRLDAYVFGTGTKVTVLGSRGGGGSGGGGSGGGGSLEMAQMQLVQSGAEVKKPGASVKVSCKTSGFPFNIFGITWVRQAPGQGLEWMGWISGYNGNTDYPQKFQGRVTMSTDTSTSTAYMELRNLKSDDTAVYYCARGAYGGMDTWGQGTLVTVSS

SEQ ID NO: 6188 - protein, 251 aa, Artificial Sequence
  Description of Artificial Sequence: Synthetic single chain variable fragment sequence
QSVVTQPPSVSGAPGQRVTISCTGSTSNIGAGYDVHWYQQLPGTAPKLLIYTNNFRPSGVPDRFSASKSGTSASLAITGLQAEDEADYYCGTWDSSLSAVVFGGGTKLTVLGSRGGGGSGGGGSGGGGSLEMAEVQLVESGTEVKKPGASVKVSCKASGYMFTSYGLNWVRQAPGQGLEWMGWISANNGKTNYAKKFQDRVTMTRDTSTSTGYMELRSLRSDDTAVYYCARHIGGSYFDRWGQGTLVTVSS

SEQ ID NO: 6189 - protein, 249 aa, Artificial Sequence
  Description of Artificial Sequence: Synthetic single chain variable fragment sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLGSRGGGGSGGGGSGGGGSLEMAEVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSS

SEQ ID NO: 6190 - protein, 247 aa, Artificial Sequence
  Description of Artificial Sequence: Synthetic single chain variable fragment sequence
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSS

SEQ ID NO: 6191 - protein, 245 aa, Artificial Sequence
  Description of Artificial Sequence: Synthetic single chain variable fragment sequence
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLGSRGGGGSGGGGSGGGGSLEMAEVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSS

SEQ ID NO: 6192 - protein, 244 aa, Artificial Sequence
  Description of Artificial Sequence: Synthetic single chain variable fragment sequence
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLLSSVTAADTAVYYCARYYPGMDMWGQGTLVTVSS

SEQ ID NO: 6193 - protein, 247 aa, Artificial Sequence
  Description of Artificial Sequence: Synthetic single chain variable fragment sequence
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLGSRGGGGSGGGGSGGGGSLEMAQVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSS

SEQ ID NO: 6194 - protein, 265 aa, Artificial Sequence
  Description of Artificial Sequence: Synthetic single chain variable fragment sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLGSRGGGGSGGGGSGGGGSLEMAQVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSS

SEQ ID NO: 6195 - protein, 249 aa, Artificial Sequence
  Description of Artificial Sequence: Synthetic single chain variable fragment sequence
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLGSRGGGGSGGGGSGGGGSLEMAQVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSS

SEQ ID NO: 6196 - protein, 249 aa, Artificial Sequence
  Description of Artificial Sequence: Synthetic single chain variable fragment sequence
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSS

SEQ ID NO: 6197 - protein, 252 aa, Artificial Sequence
  Description of Artificial Sequence: Synthetic single chain variable fragment sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLGSRGGGGSGGGGSGGGGSLEMAEVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSS

SEQ ID NO: 6198 - protein, 249 aa, Artificial Sequence
  Description of Artificial Sequence: Synthetic single chain variable fragment sequence
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSS

SEQ ID NO: 6199 - protein, 250 aa, Artificial Sequence
  Description of Artificial Sequence: Synthetic single chain variable fragment sequence
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLGSRGGGGSGGGGSGGGGSLEMAQMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSS

SEQ ID NO: 6200 - protein, 247 aa, Artificial Sequence
  Description of Artificial Sequence: Synthetic single chain variable fragment sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSS

SEQ ID NO: 6201 - protein, 249 aa, Artificial Sequence
  Description of Artificial Sequence: Synthetic single chain variable fragment sequence
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSS

SEQ ID NO: 6202 - protein, 259 aa, Artificial Sequence
  Description of Artificial Sequence: Synthetic single chain variable fragment sequence
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLGSRGGGGSGGGGSGGGGSLEMAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSS

SEQ ID NO: 6203 - protein, 251 aa, Artificial Sequence
  Description of Artificial Sequence: Synthetic single chain variable fragment sequence
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAQVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSS

SEQ ID NO: 6204 - protein, 249 aa, Artificial Sequence
  Description of Artificial Sequence: Synthetic single chain variable fragment sequence
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLGSRGGGGSGGGGSGGGGSLEMAQVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSS

SEQ ID NO: 6205 - protein, 250 aa, Artificial Sequence
  Description of Artificial Sequence: Synthetic single chain variable fragment sequence
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLGSRGGGGSGGGGSGGGGSLEMAQMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSS

SEQ ID NO: 6206 - protein, 251 aa, Artificial Sequence
  Description of Artificial Sequence: Synthetic single chain variable fragment sequence
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLGSRGGGGSGGGGSGGGGSLEMAEVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSS

SEQ ID NO: 6207 - protein, 248 aa, Artificial Sequence
  Description of Artificial Sequence: Synthetic single chain variable fragment sequence
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLGSRGGGGSGGGGSGGGGSLEMAQVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSS

SEQ ID NO: 6208 - protein, 251 aa, Artificial Sequence
  Description of Artificial Sequence: Synthetic single chain variable fragment sequence
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSS

SEQ ID NO: 6209 - protein, 249 aa, Artificial Sequence
  Description of Artificial Sequence: Synthetic single chain variable fragment sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSS

SEQ ID NO: 6210 - protein, 248 aa, Artificial Sequence
  Description of Artificial Sequence: Synthetic single chain variable fragment sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLGSRGGGGSGGGGSGGGGSLEMAQMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSS

SEQ ID NO: 6211 - protein, 251 aa, Artificial Sequence
  Description of Artificial Sequence: Synthetic single chain variable fragment sequence
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSS

SEQ ID NO: 6212 - protein, 249 aa, Artificial Sequence
  Description of Artificial Sequence: Synthetic single chain variable fragment sequence
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSS

SEQ ID NO: 6213 - protein, 249 aa, Artificial Sequence
  Description of Artificial Sequence: Synthetic single chain variable fragment sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSS

SEQ ID NO: 6214 - protein, 249 aa, Artificial Sequence
  Description of Artificial Sequence: Synthetic single chain variable fragment sequence
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSS

SEQ ID NO: 6215 - protein, 255 aa, Artificial Sequence
  Description of Artificial Sequence: Synthetic single chain variable fragment sequence
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLGSRGGGGSGGGGSGGGGSLEMAQVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSS

SEQ ID NO: 6216 - protein, 254 aa, Artificial Sequence
  Description of Artificial Sequence: Synthetic single chain variable fragment sequence
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLGSRGGGGSGGGGSGGGGSLEMAQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSS

SEQ ID NO: 6217 - protein, 248 aa, Artificial Sequence
  Description of Artificial Sequence: Synthetic single chain variable fragment sequence
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLGSRGGGGSGGGGSGGGGSLEMAQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSS

SEQ ID NO: 6218 - protein, 245 aa, Artificial Sequence
  Description of Artificial Sequence: Synthetic single chain variable fragment sequence
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSS

SEQ ID NO: 6219 - protein, 257 aa, Artificial Sequence
  Description of Artificial Sequence: Synthetic single chain variable fragment sequence
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSS

SEQ ID NO: 6220 - protein, 250 aa, Artificial Sequence
  Description of Artificial Sequence: Synthetic single chain variable fragment sequence
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSS

SEQ ID NO: 6221 - protein, 252 aa, Artificial Sequence
  Description of Artificial Sequence: Synthetic single chain variable fragment sequence
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSS

SEQ ID NO: 6222 - protein, 256 aa, Artificial Sequence
  Description of Artificial Sequence: Synthetic single chain variable fragment sequence
QSALTQPASVSGSPGQSITISCTGTSSDIGGYNYVSWYQQHPGKAPKLMIYDVSNRPSGVSNRFSGSKSGNTASLTISGLQAEDEADYYCISYTRTWNPYVFGSGTKVTVLGSRGGGGSGGGGSGGGGSLEMAEVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSS

SEQ ID NO: 6223 - protein, 250 aa, Artificial Sequence
  Description of Artificial Sequence: Synthetic single chain variable fragment sequence
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLGSRGGGGSGGGGSGGGGSLEMAEVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSS

SEQ ID NO: 6224 - protein, 250 aa, Artificial Sequence
  Description of Artificial Sequence: Synthetic single chain variable fragment sequence
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLGSRGGGGSGGGGSGGGGSLEMAEVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSS

SEQ ID NO: 6225 - protein, 254 aa, Artificial Sequence
  Description of Artificial Sequence: Synthetic single chain variable fragment sequence
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLGSRGGGGSGGGGSGGGGSLEMAQVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDRGQGTMVTVSS

SEQ ID NO: 6226 - protein, 248 aa, Artificial Sequence
  Description of Artificial Sequence: Synthetic single chain variable fragment sequence
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSS

SEQ ID NO: 6227 - protein, 253 aa, Artificial Sequence
  Description of Artificial Sequence: Synthetic single chain variable fragment sequence
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLGSRGGGGSGGGGSGGGGSLEMAEVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDRGQGTMVTVSS

SEQ ID NO: 6228 - protein, 253 aa, Artificial Sequence
  Description of Artificial Sequence: Synthetic single chain variable fragment sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGSRGGGGSGGGGSGGGGSLEMAQVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSS

SEQ ID NO: 6229 - protein, 257 aa, Artificial Sequence
  Description of Artificial Sequence: Synthetic single chain variable fragment sequence
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDRGQGTMVTVSS

SEQ ID NO: 6230 - protein, 251 aa, Artificial Sequence
  Description of Artificial Sequence: Synthetic single chain variable fragment sequence
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSS

SEQ ID NO: 6231 - protein, 250 aa, Artificial Sequence
  Description of Artificial Sequence: Synthetic single chain variable fragment sequence
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAEVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSS

SEQ ID NO: 6232 - protein, 256 aa, Artificial Sequence
  Description of Artificial Sequence: Synthetic single chain variable fragment sequence
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 6233 - protein, 256 aa, Artificial Sequence
  Description of Artificial Sequence: Synthetic single chain variable fragment sequence
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSS

SEQ ID NO: 6234 - protein, 254 aa, Artificial Sequence
  Description of Artificial Sequence: Synthetic single chain variable fragment sequence
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDRGQGTMVTVSS

SEQ ID NO: 6235 - protein, 250 aa, Artificial Sequence
  Description of Artificial Sequence: Synthetic single chain variable fragment sequence
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSS

SEQ ID NO: 6236 - protein, 248 aa, Artificial Sequence
  Description of Artificial Sequence: Synthetic single chain variable fragment sequence
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSS

SEQ ID NO: 6237 - protein, 247 aa, Artificial Sequence
  Description of Artificial Sequence: Synthetic single chain variable fragment sequence
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLSSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDRGQGTMVTVSS

SEQ ID NO: 6238 - protein, 256 aa, Artificial Sequence
  Description of Artificial Sequence: Synthetic single chain variable fragment sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLGSRGGGGSGGGGSGGGGSLEMAQVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSS

SEQ ID NO: 6239 - protein, 247 aa, Artificial Sequence
  Description of Artificial Sequence: Synthetic single chain variable fragment sequence
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSS

SEQ ID NO: 6240 - protein, 253 aa, Artificial Sequence
  Description of Artificial Sequence: Synthetic single chain variable fragment sequence
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLGSRGGGGSGGGGSGGGGSLEMAEVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNRGRGTMVTVSS

SEQ ID NO: 6241 - protein, 250 aa, Artificial Sequence
  Description of Artificial Sequence: Synthetic single chain variable fragment sequence
QPVLTQPPSVSVSPGQTAAIPCSGDKLGDKFASWYQQKPGQSPVLVIYQDTKRPSGIPERFSGSNSGNTATLTISGTQAMDEADYYCQTWASGRVVFGGGTKLTVLGSRGGGGSGGGGSGGGGSLEMAQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSS

SEQ ID NO: 6242 - protein, 253 aa, Artificial Sequence
  Description of Artificial Sequence: Synthetic single chain variable fragment sequence
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKRSRGGGGSGGGGSGGGGSLEMAEVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSS

SEQ ID NO: 6243 - protein, 256 aa, Artificial Sequence
  Description of Artificial Sequence: Synthetic single chain variable fragment sequence
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSS

SEQ ID NO: 6244 - protein, 248 aa, Artificial Sequence
  Description of Artificial Sequence: Synthetic single chain variable fragment sequence
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSS

SEQ ID NO: 6245 - protein, 260 aa, Artificial Sequence
  Description of Artificial Sequence: Synthetic single chain variable fragment sequence
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLGSRGGGGSGGGGSGGGGSLEMAEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSS

SEQ ID NO: 6246 - protein, 260 aa, Artificial Sequence; identical to SEQ ID NO: 6245
  Description of Artificial Sequence: Synthetic single chain variable fragment sequence

SEQ ID NO: 6247 - protein, 264 aa, Artificial Sequence
  Description of Artificial Sequence: Synthetic single chain variable fragment sequence
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLGSRGGGGSGGGGSGGGGSLEMAEVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSS

SEQ ID NO: 6248 - protein, 259 aa, Artificial Sequence
  Description of Artificial Sequence: Synthetic single chain variable fragment sequence
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLGSRGGGGSGGGGSGGGGSLEMAQVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSS

SEQ ID NO: 6249 - protein, 251 aa, Artificial Sequence
  Description of Artificial Sequence: Synthetic single chain variable fragment sequence
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLGSRGGGGSGGGGSGGGGSLEMAEVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDVGQGTMVTVSS

SEQ ID NO: 6250 - protein, 248 aa, Artificial Sequence
  Description of Artificial Sequence: Synthetic single chain variable fragment sequence
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAQVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSS

SEQ ID NO: 6251 - protein, 253 aa, Artificial Sequence
  Description of Artificial Sequence: Synthetic single chain variable fragment sequence
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLGSRGGGGSGGGGSGGGGSLEMAQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSS

SEQ ID NO: 6252 - protein, 274 aa, Artificial Sequence; identical to SEQ ID NO: 6175
  Description of Artificial Sequence: Synthetic single chain variable fragment sequence

SEQ ID NO: 6253 - protein, 274 aa, Artificial Sequence; identical to SEQ ID NO: 6177
  Description of Artificial Sequence: Synthetic single chain variable fragment sequence

SEQ ID NO: 6254 - protein, 275 aa, Artificial Sequence; identical to SEQ ID NO: 6167
  Description of Artificial Sequence: Synthetic single chain variable fragment sequence

SEQ ID NO: 6255 - protein, 273 aa, Artificial Sequence; identical to SEQ ID NO: 6168
  Description of Artificial Sequence: Synthetic single chain variable fragment sequence

SEQ ID NO: 6256 - protein, 271 aa, Artificial Sequence; identical to SEQ ID NO: 6169
  Description of Artificial Sequence: Synthetic single chain variable fragment sequence

SEQ ID NO: 6257 - protein, 278 aa, Artificial Sequence
  Description of Artificial Sequence: Synthetic single chain variable fragment sequence
QSALTQPASVSGSPGQSRRISCTGTSSDVGGYNYVSWYQQHPGKAPKLMIYDVSNRPSGVSNRFSGSKSGNTASLTISGLQAEDEADYYCSSYTSSSTSKVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKYNFHVYYDYWGQGTLVTVSSTSGQAGQHHHHHHGAYPYDVPDYAS

SEQ ID NO: 6258 - protein, 277 aa, Artificial Sequence; identical to SEQ ID NO: 6171
  Description of Artificial Sequence: Synthetic single chain variable fragment sequence

SEQ ID NO: 6259 - protein, 274 aa, Artificial Sequence
  Description of Artificial Sequence: Synthetic single chain variable fragment sequence
QSALTQPASVSGSPGQSITISCTGTSSDVGGYNSVSWYQQHPGKAPRLMIYDVSNRPSGVSNRFSGSKSGNTASLTISGLQAEDEADYYCSSYTSSSTPLVFGTGTKVTVLGSRGGGGSGGGGSGGGGSLEMAQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGAVAYHDWGQGTLVTVSSTSGQAGQHHHHHHGAYPYDVPDYAS

SEQ ID NO: 6260 - protein, 275 aa, Artificial Sequence
  Description of Artificial Sequence: Synthetic single chain variable fragment sequence
QSVVTQPPSVSAAPGQRVTISCSGSSSNISIYDVSWYQQLPGTAPKLLIYGNNKRPSGIADRFSGSTSGTSATLGITGLQTGDEADYYCGTWDDSLSGGVFGGGTKLTVLGSRGGGGSGGGGSGGGGSLEMAQMQLVQSGAEVKKPGSSVKVSCEASGGTLSSYAINWVRQAPGQGLEWMGGIIPMFGTAHYAQKFQGRVTITADESTKTAYMELSSLRSEDTAVYYCARGVHYASFDHWGQGTLVTVSSTSGQAGQHHHHHHGAYPYDVPDYAS

SEQ ID NO: 6261 - protein, 274 aa, Artificial Sequence; identical to SEQ ID NO: 6174
  Description of Artificial Sequence: Synthetic single chain variable fragment sequence

SEQ ID NO: 6262 - protein, 276 aa, Artificial Sequence; identical to SEQ ID NO: 6176
  Description of Artificial Sequence: Synthetic single chain variable fragment sequence

SEQ ID NO: 6263 - protein, 274 aa, Artificial Sequence
  Description of Artificial Sequence: Synthetic single chain variable fragment sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVLGSRGGGGSGGGGSGGGGSLEMAEVQLVETGGGLVQPGGSLRLSCAASGFTFSSYAMSWVRQAPGKGLEWVSAISGSDGSTYYADSVKGRFTISRDNSKNTLYLQMNSLRDEDTAVYYCARSHEANLVGDWWGQGTLVTVSSTSGQAGQHHHHHHGAYPYDVPDYAS

SEQ ID NO: 6264 - protein, 272 aa, Artificial Sequence
  Description of Artificial Sequence: Synthetic single chain variable fragment sequence
QSVVTQPPSVSVAPGKTARITCGGNNIGSKSVHWYQQKPGQAPVLVIYYDSDRPSGIPERFSGSNSGNTATLTISRVEAGDEADYYCQVWDSSSDVVFGGGTKLTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGGFGAVDHWGQGTLVTVSSTSGQAGQHHHHHHGAYPYDVPDYAS

SEQ ID NO: 6265 - protein, 270 aa, Artificial Sequence
  Description of Artificial Sequence: Synthetic single chain variable fragment sequence
SSELTQDPAVSVALGQTVKITCQGDSLTDYHATWYQQKPGQAPVAVIYATNNRPTGIPDRFSGSSSGNTASLTITGAQAEDEADYYCNSRDSGTDEVLFGGGTKLTVLGSRGGGGSGGGGSGGGGSLEMAEVQLVETGGGLVKPGGSLRLSCAASGFTFSSYSMNWVRQAPGKGLEWVSSISSSSSYIYYADSVKGRFTISRDNAKNSLYLQMNSLRAEDTAVYYCARGQGYDYWGQGTLVTVSSTSGQAGQHHHHHHGAYPYDVPDYAS

SEQ ID NO: 6266 - protein, 270 aa, Artificial Sequence
  Description of Artificial Sequence: Synthetic single chain variable fragment sequence
SYVLTQPPSVSVAPGKTARITCGGNNIGSKSVHWYQQKPGQAPVLVVYDDSDRPSGIPERFSGSNSGNTATLSISRVEAGDEADYYCQVWDSSSDHTVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARYYPGMDMWGQGTLVTVSSTSGQAGQHHHHHHGAYPYDVPDYAS

SEQ ID NO: 6267 - protein, 272 aa, Artificial Sequence
  Description of Artificial Sequence: Synthetic single chain variable fragment sequence
QAVLTQPPSTSGTPGQRVTISCSGSSSNIGRNGVNWYQQLPGAAPKVLIYNDNQRPSGVPDRVSGSQSGSSGTLAIDGLRSEDEADYYCAAWDDSLHGVVFGGGTKLTVLGSRGGGGSGGGGSGGGGSLEMAQVQLVQSGAEVKKPGASVKVSCKVSGYTLNELSMHWVRQAPGKGLEWMGGFDPEDGETIYAQKFQGRVTMTEDTSTDTAYMELSSLRSEDTAVYYCARGGYGDSWGQGTLVTVSSTSGQAGQHHHHHHGAYPYDVPDYAS

SEQ ID NO: 6268 - protein, 290 aa, Artificial Sequence
  Description of Artificial Sequence: Synthetic single chain variable fragment sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNSWVFGGGTKLTVLGSRGGGGSGGGGSGGGGSLEMAQVQLVQSGAEVKRPGSSVKVSCTASGGTFSSDAISWVRQAPGQGLEWMGGIIPMFGTANYAQKFQGRVTITADESTSTAYMELSSLRSEDTAVYYCAREGYYYPSAYLGSVLNDISSVYDEWGQGTLVTVSSTSGQAGQHHHHHHGAYPYDVPDYAS

SEQ ID NO: 6269 - protein, 274 aa, Artificial Sequence
  Description of Artificial Sequence: Synthetic single chain variable fragment sequence
QSVVTQPPSVSAAPGQKVTISCSGSTSNIGNNDVSWYQQLPGTAPKLLIYDNNKRPSGIPDRFSGSKSGTSATLGITGLQTGDEADYYCGTWDSSVSASWVFGRGTKLTVLGSRGGGGSGGGGSGGGGSLEMAQVQLVQSGAEVKKPGASVKVSCKASGYTFTSYGISWVRQAPGQGLEWMGWISAYNGNTNYPQKLQGRVTMTTDPSTSTAYMELRSLRSDDTAVYYCARSMTSFDYWGQGTLVTVSSTSGQAGQHHHHHHGAYPYDVPDYAS

SEQ ID NO: 6270 - protein, 274 aa, Artificial Sequence
  Description of Artificial Sequence: Synthetic single chain variable fragment sequence
QSVLTQPPSVSAAPGQKVTISCSGSNSNIGNNYVSWYQQLPGTAPKLLIYDNNKRPSGIPDRFSGSRSGTSATLGITGLQTGDEADYYCGTWNTTVTPGYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAMYYCARSVYDLDTWGQGTLVTVSSTSGQAGQHHHHHHGAYPYDVPDYAS

SEQ ID NO: 6271 - protein, 277 aa, Artificial Sequence
  Description of Artificial Sequence: Synthetic single chain variable fragment sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLGAPYVFGTGTKVTVLGSRGGGGSGGGGSGGGGSLEMAEVQLVQSWGGSEQPGRSLRLSCAASGFTFDDYAMHWVRQAPGKGLEWVSGISWNSGSIGYADSVKGRFTISRDNAKNSLYLQMNSLRAEDTAMYYCARYRQVGSAYDSWGQGTLVTVSSTSGQAGQHHHHHHGAYPYDVPDYAS

SEQ ID NO: 6272 - protein, 274 aa, Artificial Sequence
  Description of Artificial Sequence: Synthetic single chain variable fragment sequence
LPVLTQPPSVSVAPGKTARITCGGNNIGSKSVHWYQQKPGQAPVLVVYADSDRPSGIPERFSGSNSGNTATLTISRVEAGDEADYYCQVWDSSSYHNYVFGTGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELSSLRSEDTAMYYCARYWGFGVSDRWGQGTLVTVSSTSGQAGQHHHHHHGAYPYDVPDYAS

SEQ ID NO: 6273 - protein, 275 aa, Artificial Sequence
  Description of Artificial Sequence: Synthetic single chain variable fragment sequence
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNLWVFGGGTKLTVLGSRGGGGSGGGGSGGGGSLEMAQMQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYYYDSWGQGTLVTVSSTSGQAGQHHHHHHGAYPYDVPDYAS

SEQ ID NO: 6274 - protein, 272 aa, Artificial Sequence
  Description of Artificial Sequence: Synthetic single chain variable fragment sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAMYYCARYWGYDSYDEWGQGTLVTVSSTSGQAGQHHHHHHGAYPYDVPDYAS

SEQ ID NO: 6275 - protein, 274 aa, Artificial Sequence
  Description of Artificial Sequence: Synthetic single chain variable fragment sequence
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARNNHYYNDYWGQGTLVTVSSTSGQAGQHHHHHHGAYPYDVPDYAS

SEQ ID NO: 6276 - protein, 284 aa, Artificial Sequence
  Description of Artificial Sequence: Synthetic single chain variable fragment sequence
QSVLTQPPSVSGAPGQGVTIPCTGSSSNIGAGYDVHWYQQLPGTAPKLLIYGNNNRPSGVPDRFSGSRSGSSASLAITGLQAEDEADYYCQSYDSSLSDVVFGGGTKVTVLGSRGGGGSGGGGSGGGGSLEMAEVQLVQSGAEVKKPGATVKISCKVSGYTFTDYYMHWVQQAPGKGLEWMGLVDPEDGETIYAEKFQGRVTITADTSTDTAYMELSSLRSEDTAVYYCARYWSYSFDYLYMPEGNDWWGQGTLVTVSSTSGQAGQHHHHHHGAYPYDVPDYAS

SEQ ID NO: 6277 - protein, 276 aa, Artificial Sequence
  Description of Artificial Sequence: Synthetic single chain variable fragment sequence
QSVLTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAQVQLVQSGAEVKKPGDSVKVSCKPSGYNFLNYGINWVRQAPGQGLEWMGWISTYTGNTNYAQKLQGRVTFTTDTSTSTAYMEMRSLRSDDTAVYYCARDLYYYEGVDYWGQGTLVTVSSTSGQAGQHHHHHHGAYPYDVPDYAS

SEQ ID NO: 6278 - protein, 274 aa, Artificial Sequence
  Description of Artificial Sequence: Synthetic single chain variable fragment sequence
QAVLTQPPSVSVAPGKTARVTCGGNNIGSESVHWYQQKPGQAPVLVIYYDTDRPSGIPERFSGSHSGTTATLTISRVEAGDEADYYCQVWDSSRDHVVFGGGTKLTVLGSRGGGGSGGGGSGGGGSLEMAQVQLVQSGGGVVQPGRSLRLSCAASGFTFSSYAMHWVRQAPGKGLEWVAVISYDGSNKYYADSVKGLFTISRDNSKNTLYLQMNSLRAEDTAVYYCARSYFTSGFYDYWGQGTLVTVSSTSGQAGQHHHHHHGAYPYDVPDYAS

SEQ ID NO: 6279 - protein, 275 aa, Artificial Sequence
  Description of Artificial Sequence: Synthetic single chain variable fragment sequence
QSVVTQPPSVSGAPGQRVTISCTGSSSNIGAGYDVNWYQQFPGTAPKLLIYGNSNRPSGVPDRFSGSKSGTSASLAITGLQAEDEADYYCQSYDSSLSGSYVFGTGTKVTVLGSRGGGGSGGGGSGGGGSLEMAQMQLVQSGAEVKKPGASVKVSCKASGYTLTELSMHWVRQAPGKGLEWMGGFDPEDGETIYAQKFQGRVTMTEDTSTDTAYMELSSLRSEDTAVYYCARMSSMYYDWGQGTLVTVSSTSGQAGQHHHHHHGAYPYDVPDYAS

SEQ ID NO: 6280 - protein, 269 aa, Artificial Sequence
  Description of Artificial Sequence: Synthetic single chain variable fragment sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLGSRGGGGSGGGGSGGGGSLEMAEVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSSTSGQAGQHHHHHHGAYPYDVPDYAS

SEQ ID NO: 6281 - protein, 276 aa, Artificial Sequence
  Description of Artificial Sequence: Synthetic single chain variable fragment sequence
LPVLTQPPSASGTPGQRVTISCSGSSSNVGSYTVNWYRQLPGTAPTLLIYNNNQRPSGVPDRFSDSKSGTSASLTISGLQPEDEADYYCAAWDDRLGGYVFGTGTKVTVLGSRGGGGSGGGGSGGGGSLEMAEVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARSTGSSHMSDEWGQGTLVTVSSTSGQAGQHHHHHHGAYPYDVPDYAS

SEQ ID NO: 6282 - protein, 273 aa, Artificial Sequence
  Description of Artificial Sequence: Synthetic single chain variable fragment sequence
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHWVFGGGTKLTVLGSRGGGGSGGGGSGGGGSLEMAQVQLQQWGAGLLKPSETLSLTCAVYGGSFSGYYWSWIRQPPGKGLEWIGEITHSGRSNYNPSLKSRVTISVDTSKNQFSLKLSSVTAADTAVYYCARSSIMSDYWGQGTLVTVSSTSGQAGQHHHHHHGAYPYDVPDYAS

SEQ ID NO: 6283 - protein, 276 aa, Artificial Sequence
  Description of Artificial Sequence: Synthetic single chain variable fragment sequence
QSVLTQPPSVSGAPGQRVTISCTGSTSNIGAGYDVHWYQQLPGTAPKLLINNNRNRPSGVPDRFSGSKSGTSATLGITGLQTGDEADYYCGTWDGSLTGAVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGSALDHYDRWGQGTLVTVSSTSGQAGQHHHHHHGAYPYDVPDYAS

SEQ ID NO: 6284 - protein, 274 aa, Artificial Sequence
  Description of Artificial Sequence: Synthetic single chain variable fragment sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSTNWVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARYNYYFNDYWGQGTLVTVSSTSGQAGQHHHHHHGAYPYDVPDYAS

SEQ ID NO: 6285 - protein, 273 aa, Artificial Sequence
  Description of Artificial Sequence: Synthetic single chain variable fragment sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKVTVLGSRGGGGSGGGGSGGGGSLEMAQMQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSMFGAHDSWGQGTLVTVSSTSGQAGQHHHHHHGAYPYDVPDYAS

SEQ ID NO: 6286 - protein, 276 aa, Artificial Sequence
  Description of Artificial Sequence: Synthetic single chain variable fragment sequence
QSVLTQPPSVSGAPGQRVTISCTGSSSNIGAGFDVHWYQLLPGTAPKLLIYANSNRPSGVPDRFSGSKSGTSASLAITGLLAEDEADYYCQSYDSSLSGVVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGASFDRHDNWGQGTLVTVSSTSGQAGQHHHHHHGAYPYDVPDYAS

SEQ ID NO: 6287 - protein, 274 aa, Artificial Sequence
  Description of Artificial Sequence: Synthetic single chain variable fragment sequence
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSNYYYNDYWGQGTLVTVSSTSGQAGQHHHHHHGAYPYDVPDYAS

SEQ ID NO: 6288 - protein, 274 aa, Artificial Sequence
  Description of Artificial Sequence: Synthetic single chain variable fragment sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCARYSGVYYDWGQGTLVTVSSTSGQAGQHHHHHHGAYPYDVPDYAS

SEQ ID NO: 6289 - protein, 274 aa, Artificial Sequence
  Description of Artificial Sequence: Synthetic single chain variable fragment sequence
NFMLTQPHSVSGSPGKTVTISCTGSSGSIADNFVQWYQQRPGGVPTTVIFNDDERPSGVPDRFSGSIDTSSNSASLTISGLKTEDEADYYCQSYDNNNRGVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSNLRSEDTAVYYCARYYSYGYDWGQGTLVTVSSTSGQAGQHHHHHHGAYPYDVPDYAS

SEQ ID NO: 6290 - protein, 280 aa, Artificial Sequence
  Description of Artificial Sequence: Synthetic single chain variable fragment sequence
QSVVTQPPSVSGAPGQTVTISCTGGSSNIGTGYFVNWYQQVPGKAPKLLILGNNNRPSGVPDRLSGSTSGTSASLAITGLQAEDEGTYYCQSYDSSLSGYVFGTGTKVTVLGSRGGGGSGGGGSGGGGSLEMAQVQLQQSGPGLVKPSQTLSLTCGISGDSVSTNSVAWHWIRQSPSRGLEWLGRTYYRSKWSNDYGVSVKSRITIIPDTSKNQFSLQLNSVTPEDTAVYYCARSSSWYQIFDYWGQGTLVTVSSTSGQAGQHHHHHHGAYPYDVPDYAS

SEQ ID NO: 6291 - protein, 279 aa, Artificial Sequence
  Description of Artificial Sequence: Synthetic single chain variable fragment sequence
NFMLTQPHSVSESPGKTVTISCTGSSDSIANNYVQWYQQRPGSAPTNVIYEDVQRPSGVPDRFSGSIDSSSNSASLTISGLKTEDEAVYYCQSYHSDNRWVFGGGTKLTVLGSRGGGGSGGGGSGGGGSLEMAQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARSGAYWDYSVYDEWGQGTLVTVSSTSGQAGQHHHHHHGAYPYDVPDYAS

SEQ ID NO: 6292 - protein, 273 aa, Artificial Sequence
  Description of Artificial Sequence: Synthetic single chain variable fragment sequence
QSVLTQPPSVSVSPGQTATIACSGHKLGDKYASWYQQKSGQSPVLIIYQDNKRPSGIPERFSGSNSGNTATLTISGTQALDEADYYCQAWDSSTYVAFGGGTKLTVLGSRGGGGSGGGGSGGGGSLEMAQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARMTTHTFGYDAWGQGTLVTVSSTSGQAGQHHHHHHGAYPYDVPDYAS

SEQ ID NO: 6293 - protein, 270 aa, Artificial Sequence
  Description of Artificial Sequence: Synthetic single chain variable fragment sequence
QPVLTQPPSVSVAPGKTATITCGGNNIGSESVHWYHQKPGQAPVLVIYDDAGRPSGIPERFTGSNSGNTATLTISRVEAGDEADYYCQVWDRNSAQFVFGPGTKVTVLGSRGGGGSGGGGSGGGGSLEMAEVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGVHLDWWGQGTLVTVSSTSGQAGQHHHHHHGAYPYDVPDYAS

SEQ ID NO: 6294 - protein, 282 aa, Artificial Sequence
  Description of Artificial Sequence: Synthetic single chain variable fragment sequence
QSVVTQPPSASGTPGQRVTISCSGSSSNIGSNYVYWYQQLPGTAPKLLIYSNNQRPSGVPDRFSGSKSGTSASLAISGLRSEDEADYYCAAWDDSLSGYVFGTGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLYEGGYHGWGSWLSSDSWGQGTLVTVSSTSGQAGQHHHHHHGAYPYDVPDYAS

SEQ ID NO: 6295 - protein, 275 aa, Artificial Sequence
  Description of Artificial Sequence: Synthetic single chain variable fragment sequence
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYWVFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGAFDAFDIWGQGTMVTVSSTSGQAGQHHHHHHGAYPYDVPDYAS

SEQ ID NO: 6296 - protein, 277 aa, Artificial Sequence
  Description of Artificial Sequence: Synthetic single chain variable fragment sequence
SYELTQPPSASGTPGQRVTISCSGSSSNIGSNYVYWYQQLPGTAPKLFIYRNNQRPSGVPDRFSGSKSGTSASLAISGLRSEDEADYYCAAWDDSLSGYLFGTGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCANGDSNYYYGMDVWGQGTTVTVSSTSGQAGQHHHHHHGAYPYDVPDYAS

SEQ ID NO: 6297 - protein, 279 aa, Artificial Sequence
  Description of Artificial Sequence: Synthetic single chain variable fragment sequence
QSALTQPASVSGSPGQSMSCTGTSSDIGGYNYVSWYQQHPGKAPKLMIYDVSNRPSGVSNRFSGSKSGNTASLTISGLQAEDEADYYCISYTRTWNPYVFGSGTKVTVLGSRGGGGSGGGGSGGGGSLEMAEVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDRAAAGYYYYGMDVWGQGTTVTVSSTSGQAGQHHHHHHGAYPYDVPDYAS

SEQ ID NO: 6298 - protein, 275 aa, Artificial Sequence
  Description of Artificial Sequence: Synthetic single chain variable fragment sequence
LPVLTQPPSVSVSPGQTAIITCSGDKLGEKYVSWYQQKPGQSPVLVIDQDTRRPSGIPERFSGSNSGTTATLTISGTQAMDEADYYCQAWDRGVVFGGGTKLTVLGSRGGGGSGGGGSGGGGSLEMAEVQLVESGGDLVQPGRSLRLSCAASGFTFNDYAMHWVRQAPGKGLEWVSGISWSGNNIGYADSVKGRFTISRDNAKNSLYLQMNSLRAEDTALYYCAKDSIRYGITWGGFDYWGQGTLVTVSSTSGQAGQHHHHHHGAYPYDVPDYAS

SEQ ID NO: 6299 - protein, 275 aa, Artificial Sequence
  Description of Artificial Sequence: Synthetic single chain variable fragment sequence
QPVLTQPPSVSKGLRQTATLTCTGNSNNVGNLGVAWLQQHQGHPPKLLSYRNNNRPSGISERLSASRSGNTASLTITGLQPEDEADYYCSAWDSSLSAWVFGGGTKLTVLGSRGGGGSGGGGSGGGGSLEMAEVQLVESGGVVVQPGGSLRLSCAASGFTFDDYAMHWVRQAPGKGLEWVSLINWDGGSTYYADSVKGRFTISRDNSKNSLYLQMNSLRAEDTALYYCAKGMGLRAFDYWGQGTLVTVSSTSGQAGQHHHHHHGAYPYDVPDYAS

SEQ ID NO: 6300 - protein, 279 aa, Artificial Sequence
  Description of Artificial Sequence: Synthetic single chain variable fragment sequence
QSVLTQPPSASGTPGQRVTISCSGSSSNIGSNTVNWYQQLPGTAPKLLIYSNDQRPSGVPDRFSGSKSGTSASLAISGLQSEDEADYYCASWDDSLNGRYVFGTGTKVTVLGSRGGGGSGGGGSGGGGSLEMAQVQLVQSGAEVRKPGASVKVSCKTSGYTFSWYAIHWVRQAPGQRLEWMGWINAGNGNTKYSQKFQGRVSLTRDTSASTAYMELSSLRSDDTAVYYCARPDNYGSGGDVFDRGQGTMVTVSSTSGQAGQHHHHHHGAYPYDVPDYAS

SEQ ID NO: 6301 - protein, 273 aa, Artificial Sequence
  Description of Artificial Sequence: Synthetic single chain variable fragment sequence
NFMLTQPHSVSESPGKTVTISCTRSSGSIASNFVQWYQQRPGSAPTPMIYEDNNRPPGVPDRFSASVDSSSNSASLTISGLKTEDEADYYCQSYDTSNVVFGGGTKLTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 6302 - protein, 278 aa, Artificial Sequence
  Description of Artificial Sequence: Synthetic single chain variable fragment sequence
QAVLTQPPSASGAPGQRVTVSCSGSNSNIGSNYVNWYQQFPGTAPKLLMYSSSQRPSGVPDRFSGSKSGTSASLAISGLHSEDEADYYCATWDDSLNAWVFGGGTKLTVLGSRGGGGSGGGGSGGGGSLEMAEVQLVQSGAEVRKPGASVKVSCKTSGYTFTWYAIHWVRQAPGQRLEWMGWINAGSGNTKYSQKFQGRVTLTRDTSASTAYMELSSLRSDDTAVYYCARPNNYGSGGDVFDRGQGTMVTVSSTSGQAGQHHHHHHGAYPYDVPDYAS

SEQ ID NO: 6303 - protein, 278 aa, Artificial Sequence
  Description of Artificial Sequence: Synthetic single chain variable fragment sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGSRGGGGSGGGGSGGGGSLEMAQVQLVQSGAEVKKPGASVKVSCKASGYTFTNYALHWVRQAPGQGLEWMAWINGGNGNTKYSQNFQGRVTITRDTSASTAYMELSSLRSEDTAVYYCAKPEETAGTIHFDYWGQGTPVTVSSTSGQAGQHHHHHHGAYPYDVPDYAS

SEQ ID NO: 6304 - protein, 283 aa, Artificial Sequence
  Description of Artificial Sequence: Synthetic single chain variable fragment sequence
QAVLTQPHSVSESPGKTVTISCTRSSGSIASNYVQWYQQRPGSAPTTVIYEDNQRPSGVPDRFSGSIDSSSNSASLTISGLKTEDEADYYCQSYDSTITVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAGEGYYDSSGYSNGDAFDRVGQGTMVTVSSTSGQAGQHHHHHHGAYPYDVPDYAS

SEQ ID NO: 6305 - protein, 273 aa, Artificial Sequence
  Description of Artificial Sequence: Synthetic single chain variable fragment sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNVVFGGGTKVTVLGSRGGGGSGGGGSGGGGSLEMAEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARWDYGMDVWGQGTTVTVSSTSGQAGQHHHHHHGAYPYDVPDYAS

SEQ ID NO: 6306 - protein, 276 aa, Artificial Sequence
  Description of Artificial Sequence: Synthetic single chain variable fragment sequence
SYVLTQPPSVSVSPGQTASITCSGDRLTNKYVSWYQQKPGQSPVLVIYEDAKRPSGIPARFSGSNSGNTATLTISGTQAMDESEYYCQAWDSSVVVFGGGTKLTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRDEDTALYYCAKDRGGGVIVKDAFDIWGQGTMVTVSSTSGQAGQHHHHHHGAYPYDVPDYAS

SEQ ID NO: 6307 - protein, 275 aa, Artificial Sequence
  Description of Artificial Sequence: Synthetic single chain variable fragment sequence
SYELTQPPAASGTPGQRVTISCSGGVSNIGSGALNWYQQLPGTAPKLLIYSYNQRPSGVSDRFSGSRSATSASLAISGLQSEDEADYYCATWDDSVNGWVFGGGTKLTVLGSRGGGGSGGGGSGGGGSLEMAEVQLVESGAEVKKPGDSVKVSCKPSGYNFLNYGINWVRQAPGQGLEWMGWISTYTGNTNYAQKLQGRVTFTTDTSTSTAYMEMRSLRSDDTAVYYCARQQGGGWYDVWGQGTLVTVSSTSGQAGQHHHHHHGAYPYDVPDYAS

SEQ ID NO: 6308 - protein, 281 aa, Artificial Sequence
  Description of Artificial Sequence: Synthetic single chain variable fragment sequence
QSVVTQPPSVSAAPGEKVTISCSGSNFNVGNNDVSWYQQLPGAAPKLLIYDNNKRPSGIPDRFSGSKSGTSATLDITGLHSDDEADYYCGTWDSSLNTGGVFGTGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 6309 - protein, 281 aa, Artificial Sequence
  Description of Artificial Sequence: Synthetic single chain variable fragment sequence
QSVLTQPPSVSAPPGQKVTISCSGSSSNIGNNYVSWYQQFPGTAPKLLIYDNNKRPSGISDRFSGSKSGTSATLGIAGLQTGDEADYYCGTWDTSLSGFYVFGSGTKVTVLGSRGGGGSGGGGSGGGGSLEMAEVQLVQSGAEVKKPGASVKVSCKASGYTFTSYTISWVRQAPGQGLEWMGWISTYNGLTNYAQNLQGRVTMTTDTFTTTAYMELRSLRSDDTAVYYCVREGSPDYGDFASFDYWGQGTLVTVSSTSGQAGQHHHHHHGAYPYDVPDYAS

SEQ ID NO: 6310 - protein, 280 aa, Artificial Sequence
  Description of Artificial Sequence: Synthetic single chain variable fragment sequence
LPVLTQPPSASATPGQRVTISCSGTTSNIGSNTVHWYQQLPGTAPKLLIYNNNQRPSGVPDRFSGSKSGTSASLAISGLRSEDEATYSCATWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDPAYGDYEYDAFDRVGQGTMVTVSSTSGQAGQHHHHHHGAYPYDVPDYAS

SEQ ID NO: 6311 - protein, 275 aa, Artificial Sequence
  Description of Artificial Sequence: Synthetic single chain variable fragment sequence
QSVLTQPPSASGTPGQRVTISCSGSSSNIGTNGVNWFQQFPGTAPKLLIYTNDQRPSGVPDRFSGSKSGTSASLAISGLQSADEADYYCAVWDHSLNGPVFGGGTKLTVLGSRGGGGSGGGGSGGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGAGFDAFDIWGQGTMVTVSSTSGQAGQHHHHHHGAYPYDVPDYAS

SEQ ID NO: 6312 - protein, 273 aa, Artificial Sequence
  Description of Artificial Sequence: Synthetic single chain variable fragment sequence
QAVLTQPPSASGTPGQRVTISCSGSSSNIGSNTVNWYQQLPGTAPKLLIYSNNQRPSGVPDRFSGSKSGTSASLAISGLQSEDETDYYCAAWDDSLNGYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDIWGQGTMVTVSSTSGQAGQHHHHHHGAYPYDVPDYAS

SEQ ID NO: 6313 - protein, 273 aa, Artificial Sequence
  Description of Artificial Sequence: Synthetic single chain variable fragment sequence
QAVLTQPPSASGTPGQRVTISCSGSSSNIGSNTVNWYQQLPGTAPKLLMYSNDQRPSGVPDRFSGSKSGTSASLAISGLQSEDEADYYCAAWDDSLNGYVFAAGTQLTVLSSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLDAFDRVGQGTMVTVSSTSGQAGQHHHHHHGAYPYDVPDYAS

SEQ ID NO: 6314 - protein, 281 aa, Artificial Sequence
  Description of Artificial Sequence: Synthetic single chain variable fragment sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAAYVFGTGTKVTVLGSRGGGGSGGGGSGGGGSLEMAQVQLVQSGAEVKKPGASVKVSCKASGYSFTSYTISWVRQAPGQGLEWMGWVSTYNGLRNYAQNLQGRVTMTTDTLTTTAYMELRSLRSDDTAVYYCVREGSPDYGDFAAFDYWGQGTLVTVSSTSGQAGQHHHHHHGAYPYDVPDYAS

SEQ ID NO: 6315 - protein, 272 aa, Artificial Sequence
  Description of Artificial Sequence: Synthetic single chain variable fragment sequence
QAVLTQPPSASETPGQRVTISCSGSRSNIGTNIVHWYQQRPGMAPKLLTYGSRRPSGVPDRFSGSKFGTSASLAISGLQSEDEADYYCAAWDDSLNGPAFGGGTKLTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGGGYFDYWGQGTLVTVSSTSGQAGQHHHHHHGAYPYDVPDYAS

SEQ ID NO: 6316 - protein, 278 aa, Artificial Sequence
  Description of Artificial Sequence: Synthetic single chain variable fragment sequence
QSVLTQPPSVSGAPGQRVTISCTGSSSNIGARYDVHWYQQLPGTAPRLLISANYDRPSGVPDRFSGSKSGTSASLAITGLQAEDEADYYCQSYDSSVSAWVFGGGTKVTVLGSRGGGGSGGGGSGGGGSLEMAEVQLVQSGAEVKEPGASVRISCQASGYNFISYYMHWVRQAPGQGLEWMGTINPGSGETDYSQKLQGRVTMTRDPSTGTFDMGLSSLTSGDTAVYYCATGLIRGASDAFNRGRGTMVTVSSTSGQAGQHHHHHHGAYPYDVPDYAS

SEQ ID NO: 6317 - protein, 275 aa, Artificial Sequence
  Description of Artificial Sequence: Synthetic single chain variable fragment sequence
QPVLTQPPSVSVSPGQTAAIPCSGDKLGDKFASWYQQKPGQSPVLVIYQDTKRPSGIPERFSGSNSGNTATLTISGTQAMDEADYYCQTWASGRVVFGGGTKLTVLGSRGGGGSGGGGSGGGGSLEMAQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERSGWKGFDYWGQGTLVTVSSTSGQAGQHHHHHHGAYPYDVPDYAS

SEQ ID NO: 6318 - protein, 278 aa, Artificial Sequence
  Description of Artificial Sequence: Synthetic single chain variable fragment sequence
DVVMTQSPPSLSVTPGEPASITCRSSQSLLERNAYNYLDWYLQRPGQSPQLLIYLGSNRAAGVPDRFSGSGSGRDFTLKISRVEPEDVGVYYCMQALQAPFTFGGGTKVEIKRSRGGGGSGGGGSGGGGSLEMAEVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKWGPFQDAFDIWGQGTMVTVSSTSGQAGQHHHHHHGAYPYDVPDYAS

SEQ ID NO: 6319 - protein, 281 aa, Artificial Sequence
  Description of Artificial Sequence: Synthetic single chain variable fragment sequence
QAVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGAGTKVTVLGSRGGGGSGGGGSGGGGSLEMAEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARWTAVASDHHFDYWGQGTLVTVSSTSGQAGQHHHHHHGAYPYDVPDYAS

SEQ ID NO: 6320 - protein, 273 aa, Artificial Sequence
  Description of Artificial Sequence: Synthetic single chain variable fragment sequence
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLGSRGGGGSGGGGSGGGGSLEMAEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDWDYMDVWGKGTTVTVSSTSGQAGQHHHHHHGAYPYDVPDYAS

SEQ ID NO: 6321 - protein, 284 aa, Artificial Sequence
  Description of Artificial Sequence: Synthetic single chain variable fragment sequence
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVLGSRGGGGSGGGGSGGGGSLEMAEVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 6322 - protein, 285 aa, Artificial Sequence
  Description of Artificial Sequence: Synthetic single chain variable fragment sequence
QSVLTQPPSVSGAPGQRVTVSCTGSRSNIGAGYDVHWYQQLPGTAPKLLIYGNSNRPPGVPDRFSGSKSGTSASLVITGLQAEDAADYYCQSYDNTVRESPYVFGTGTKVTVLGSRGGGGSGGGGSGGGGSLEMAEVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATESNLVSRHYYYYGMDVWGQGTTVTVSSTSGQAGQHHHHHHGAYPYDVPDYAS

SEQ ID NO: 6323 - protein, 289 aa, Artificial Sequence
  Description of Artificial Sequence: Synthetic single chain variable fragment sequence
LPVLTQPPSASGTPGQRVTISCSGTSSNIGSNSVDWYQQLPGTAPKLLIYSNNQRPSGVPDRISGSKSGTSASLAISGLQSEDEADYYCAAWDDSLNGYVFGTGTKVTVLGSRGGGGSGGGGSGGGGSLEMAEVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYGYYGSGSYSSGPLYYYYGMDVWGQGTTVTVSSTSGQAGQHHHHHHGAYPYDVPDYAS

SEQ ID NO: 6324 - protein, 284 aa, Artificial Sequence
  Description of Artificial Sequence: Synthetic single chain variable fragment sequence
QAVLTQPPSASGTPGQRVTISCSGSSSNIGSNTVNWYQQLPGTAPKLLMYNNDQRPSGVPDRFSGSKSGTSASLAISGLQSEDEADYYCAAWDDSLNGYVFGPGTKVTVLGSRGGGGSGGGGSGGGGSLEMAQVQLVESGAEVKKPGASVKVSCKASGYTFTSYGISWVRQAPGQGLEWMGWISAYNGNTNYAQKLQGRVTMTTDTSTSTAYMELRSLRSDDTAVYYCARDLSRGANPHYYYYYGMDVWGQGTTVTVSSTSGQAGQHHHHHHGAYPYDVPDYAS

SEQ ID NO: 6325 - protein, 276 aa, Artificial Sequence
  Description of Artificial Sequence: Synthetic single chain variable fragment sequence
NFMLTQPHAVSESPGKTVTISCTRSSGSIASNYVQWYQQRPGSSPRTVIYEDNQRPSGVPGRFSGSIDSSSNSASLTISGLKTEDEADYYCQSYDSTSVLFGGGTKLTVLGSRGGGGSGGGGSGGGGSLEMAEVQLVQSGAEVKKPGSSVKVSCKASGGTFSSNSLSWVRQAPGQGLEWMGRIFPILGITNYAQKFQGRVTITADKSTSTAYMELSSLRSEDTAVYYCARGNYQWYDAFDVGQGTMVTVSSTSGQAGQHHHHHHGAYPYDVPDYAS

SEQ ID NO: 6326 - protein, 273 aa, Artificial Sequence
  Description of Artificial Sequence: Synthetic single chain variable fragment sequence
QPVLTQPPSVSVVPGKTARITCGGKNIGSKSVHWYQQKPGQAPVVVIHYDSDRPSGIPERFSGSNSGNTATLTISRVEAGDEADYYCQVWDSSSDHPYVFGTGTKVTVLGSRGGGGSGGGGSGGGGSLEMAQVQLVQSGAEVKKPGASVKVSCKASGYTFTNYGISWVRQAPGQGLEWMGWISAYNGNTNYAHKLQGRVTMTTDTSTSTANMELRSLRPDDTAVYYCARSYFGSHDYWGQGTLVTVSSTSGQAGQHHHHHHGAYPYDVPDYAS

SEQ ID NO: 6327 - protein, 278 aa, Artificial Sequence
  Description of Artificial Sequence: Synthetic single chain variable fragment sequence
SYVLTQPPSVSVAPGKTARISCGGNDIGSKSVFWYQQRPGQAPVLVVYDDSDRPSGLPERFSGFNSGNTATLTISRVEAGDEADYYCQVWDSSSDHYVFGTGTKVTVLGSRGGGGSGGGGSGGGGSLEMAQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDITYGSGSYGAFDIWGQGTMVTVSSTSGQAGQHHHHHHGAYPYDVPDYAS

SEQ ID NO: 6328 - protein, 244 aa, Artificial Sequence
  Description of Artificial Sequence: Synthetic single chain variable fragment sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDYVFGTGTKVTVLGSRGGGGSGGGGSGGGGSLEMAEVQLVETGGGLVKPGGSLRLSCAASGFTVSDYYMSWIRQAPGKGLEWISYISGSGNSIYYADSVKGRFTISRDNAKNSLDLQMTSLRAEDTAVYYCARSTKFDYWGQGTLVTVSS

SEQ ID NO: 6329 - protein, 257 aa, Artificial Sequence; identical to SEQ ID NO: 6219
  Description of Artificial Sequence: Synthetic single chain variable fragment sequence

SEQ ID NO: 6330 - protein, 256 aa, Artificial Sequence
  Description of Artificial Sequence: Synthetic single chain variable fragment sequence
SRAAQPAMAQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKRAA

SEQ ID NO: 6331 - protein, 504 aa, Artificial Sequence
  Description of Artificial Sequence: Synthetic single chain variable fragment sequence
QVQLQESGPGLVKPSQTLSLTCTVSGGSISSGAYYWTWIRQHPGKGLEWIGYIYYSGSTYYNPSLKSRVSISIDTSKNQFSLKLSSVTAADTAVYYCARGSSSWFDYWGQGTLVTVSSGGGGSGGGGSGGGGSQSVLTQPPSVSEAPRQRVTISCSGSSSNIGNNAVNWYQQLPGKAPKLLIYYDDMLSSGVSDRFSGSKSGTSASLAISGLQSEDEADYYCAAWDDSLNGVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 6332 - protein, 237 aa, Artificial Sequence
  Description of Artificial Sequence: Synthetic single chain variable fragment sequence
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWLRQPPGKGLEWIGVLWGDGITDYNPSLKSRVTISKDTSKNQFSLKLSSVTAADTAVYYCVTGLFDYWGQGTLVTVSS

SEQ ID NO: 6333 - protein, 237 aa, Artificial Sequence
  Description of Artificial Sequence: Synthetic single chain variable fragment sequence
QAVVTQEPSLTVSPGGTVTLTCGSSTGAVTTSNYASWVQQKPGQAPRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVLWGDGITDYNPSLKSRLTVSKDTSKNQVSLKMSSLTAADTAVYYCVTGLFDYWGQGTLLTVSS

SEQ ID NO: 6334 - protein, 237 aa, Artificial Sequence
  Description of Artificial Sequence: Synthetic single chain variable fragment sequence
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWLRQPPGKGLEWIGVLWGDGITDYNPSLKSRVTISKDTSKNQFSLKLSSVTAADTAVYYCVTGLFDYWGQGTLVTVSS

SEQ ID NO: 6335 - protein, 237 aa, Artificial Sequence
  Description of Artificial Sequence: Synthetic single chain variable fragment sequence
QAVVTQEPSLTVSPGGTVTLTCGSSTGAVTTSNYASWVQQKPGQAFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVLWGDGITDYNPSLKSRLTVSKDTSKNQVSLKMSSLTAADTAVYYCVTGLFDYWGQGTLLTVSS

SEQ ID NO: 6336 - protein, 237 aa, Artificial Sequence
  Description of Artificial Sequence: Synthetic single chain variable fragment sequence
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSLTCTVSGFLLTDYGVNWLRQPPGKGLEWIGVLWGDGITDYNPSLKSRVTISKDTSKNQFSLKLSSVTAADTAVYYCVTGLFDYWGQGTLVTVSS

SEQ ID NO: 6337 - protein, 237 aa, Artificial Sequence
  Description of Artificial Sequence: Synthetic single chain variable fragment sequence
QAVVTQEPSLTVSPGGTVTLTCGSSTGAVTTSNYASWVQQKPDHLFRGLIGGTNNRAPGVPARFSGSLLGGKAALTISGAQPEDEAEYYCVLWYSDHWVFGGGTKLTVLGGGGSGGGGSGGGGSQVQLQESGPGLVKPSETLSITCTVSGFLLTDYGVNWVRQPPGKGLEWLGVLWGDGITDYNPSLKSRLTVSKDTSKNQVSLKMSSLTAADTAVYYCVTGLFDYWGQGTLLTVSS

SEQ ID NO: 6338 - protein, 241 aa, Artificial Sequence
  Description of Artificial Sequence: Synthetic single chain variable fragment sequence
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIK

SEQ ID NO: 6339 - protein, 249 aa, Artificial Sequence
  Description of Artificial Sequence: Synthetic single chain variable fragment sequence
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSSGSTSGSGKPGSSEGSTKGDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 6340 - protein, 244 aa, Artificial Sequence
  Description of Artificial Sequence: Synthetic single chain variable fragment sequence
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGSTSGSGKPGSSEGSTKGDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 6341 - protein, 243 aa, Artificial Sequence
  Description of Artificial Sequence: Synthetic single chain variable fragment sequence
QVQLKESGPVLVAPSQTLSITCTVSGFSLASYNIHVWRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKR

SEQ ID NO: 6342 - protein, 242 aa, Artificial Sequence
  Description of Artificial Sequence: Synthetic single chain variable fragment sequence
QVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKR

SEQ ID NO: 6343 - protein, 261 aa, Artificial Sequence
  Description of Artificial Sequence: Synthetic single chain variable fragment sequence
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIK

SEQ ID NO: 6344 - protein, 239 aa, Artificial Sequence
  Description of Artificial Sequence: Synthetic single chain variable fragment sequence
EVQLLESGGGLVQPGGSLRLSCAASGFTFSSYAMSWVRQAPGKGLEWVSTIQKQGLPTEYADSVKGRFTISRDNSKNTLYLQMNSLRAEDTAVYYCAKNRAKFDYWGQGTLVTVSSGGGGSGGGGSGGGGSTDIQMTQSPSSLSASVGDRVTITCRASQSISSYLNWYQQKPGKAPKLLIYNASMLQSGVPSRFSGSGSGTDFTLTISSLQPEDFATYYCQQNRGFPLTFGQGTKVEIK

SEQ ID NO: 6345 - protein, 242 aa, Artificial Sequence
  Description of Artificial Sequence: Synthetic single chain variable fragment sequence
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIK

SEQ ID NO: 6346 - protein, 252 aa, Artificial Sequence
  Description of Artificial Sequence: Synthetic single chain variable fragment sequence
QSVLTQPPSVSAAPGQKVTIPCSGSRSNVGNYYVSWYQQLPGTAPKLLIYDNNKRPSGIPDRFSGSKSGTSATLGITGLQTGDEADYFCGTWDGSLSAHVFGTGTKVTVLGSRGGGGSGGGGSGGGGSLEMAQVQLVQSGSELKKPGASVRVSCTASGYTFTSYYMHWVRQAPGQGLEWMGVINPNAGSTRYAQKFQGRVTMSTDTSTSTAYMDLSSLRSEDTAVYYCARGMYRSLLFYDPWGQGTLVTVSS

SEQ ID NO: 6347 - protein, 250 aa, Artificial Sequence
  Description of Artificial Sequence: Synthetic single chain variable fragment sequence
NFMLTQPHSVSESPGKTVSISCTRTSGAIAGAYVQWFQQRPGSAPTTVIYDDNKRPSGVPDRFSGSIDKSSNSASLTISGLKTEDEADYYCQSYDYDSSNVLFGGGTKLTVLGSRGGGGSGGGGSGGGGSLEMAEVQLVESGGGLVQPGGSLRLSCAASGFTFSNYAMSWVRQAPGKGLEWVSAISGSGNTYYADSVKGRFTISRDNSKNTLYLQMNSLRAEDTAVYYCARGSVRYTDIWGQGTLVTVSS

SEQ ID NO: 6348 - protein, 248 aa, Artificial Sequence
  Description of Artificial Sequence: Synthetic single chain variable fragment sequence
DIQLTQSPSSLSASVGDRVTITCRASQSISSYLNWYQQKPGKAPKLLIYAASSLQSGVPSRFSGSGSGTDFTLTISSLQPADFATYYCQQSYSVPYTFGQGTKLEIKRSRGGGGSGGGGSGGGGSLEMAEVQLVQSGGGLVQPGGSLRLSCATSGFTFNNYWMSWVRQAPGKGLEWVANIKQDGSEKYYADSVRGRFTISRDNAKNSLSLQLNNLRAEDTAVYYCARSMSTAWGYDEWGQGTLVTVSS

SEQ ID NO: 6349 - protein, 253 aa, Artificial Sequence
  Description of Artificial Sequence: Synthetic single chain variable fragment sequence
QSALTQPASVSGSPGQSITISCTGTSSDVGGYNFVSWYQQHPGKAPKVMIYDVSKRPSGISNRFSGSKSGNTASLTISGLQVEDEAEYYCSSYTSTRTVIFAGGTKVTVLGSRGGGGSGGGGSGGGGSLEMAQVQLVQSGAEVKKPGASVKVSCKASGYTFTSYYMHWVRQAPGQGLEWMGIINPSGGSTRYAQKFQGRVTMTRDTSTSTVYMELSSLRSEDTAVYYCARGSSRWGGWTGDYWGQGTLVTVSS

SEQ ID NO: 6350 - protein, 249 aa, Artificial Sequence
  Description of Artificial Sequence: Synthetic single chain variable fragment sequence
  MOD_RES (37)..(37): Any amino acid
QSVLTQPPSLSGAPGQRVTISCSGSRSNIGTNYVSWXQQLPGTAPKLLIYRNHQWPSGVPDRFTGSKSGTSASLAISGLRSEDEADYYCAAWDDNLSGVVFGGGTKLTVLGSRGGGGSGGGGSGGGGSLEMAEVQLVETGGGLVQPGGSLRLSCAASGSTFSSYAMSWVRQAPGKGLEWVSAISGRGRSTYYADSVKGRFTISRDNSKNTLYLQMNSLRAEDTAVYYCARYYKSSKDHWGQGTLVTVSS

SEQ ID NO: 6351 - protein, 253 aa, Artificial Sequence
  Description of Artificial Sequence: Synthetic single chain variable fragment sequence
QAVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKVTVLGSRGGGGSGGGGSGGGGSLEMAQVQLVQSGAEVQRPGASVRVSCKAIAYTFTDYYIHWVRQAPGQGPEWMGWINPKSGRTQYAPKFQDRVTLARETPISTASMELRGLTSDDTAVYYCARVYGYSRWSGFDLWGQGTLVTVSS

SEQ ID NO: 6352 - protein, 256 aa, Artificial Sequence
  Description of Artificial Sequence: Synthetic single chain variable fragment sequence
QSALTQPASVSGSPGQSITISCTGTSRDVGGYNYVSWYQQYPGKAPKLMIYEVSKRPSGVSNRFSGSKSGNTASLTISGLQAEDEADYYCSSYTSSSTLDFGTGTKVTVLGSRGGGGSGGGGSGGGGSLEMAQVQLVQSGAEVKQPGASVKVSCQASGYTFTTYYMHWVRQAPGQGLEWMGIINPNGGGTFYAQKFQDRVTMTRDTSTGTVYMELSSLRSDDTAVYYCARGHKVYKSHPTGGYDRWGQGTLVTVSS

SEQ ID NO: 6353 - protein, 251 aa, Artificial Sequence
  Description of Artificial Sequence: Synthetic single chain variable fragment sequence
SYELTQPPSASGTPGQRVTISCSGSSSNIGSNYVSWYQQLPGTAPKLLIYRNNQRPSGVPDRFSGSKSGTSASLAISGLRSEDEADYYCAAWDDSLSGVVFGGGTKLTVLGSRGGGGSGGGGSGGGGSLEMAEVQLVQSGAEVKKPGSSVKVSCKASGGTFSSYAISWVRQAPGQGLEWMGGIIPIFGTAKYAQKFQGRVTITADESTSTAYMELSSLRSEDTAVYYCARSHVAWSLLDYWGQGTLVTVSS

SEQ ID NO: 6354 - protein, 252 aa, Artificial Sequence
  Description of Artificial Sequence: Synthetic single chain variable fragment sequence
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTKLTVLGSRGGGGSGGGGSGGGGSLEMAQVQLVQSGAEVKKPGSSVKVSCKASGGTFSSYAISWVRQAPGQGLEWMGWMNPNSGNTGYAQKFQGRVTMTRNTSISTAYMELSSLRSEDTAVYYCARYQSYKGSQSDSWGQGTLVTVSS

SEQ ID NO: 6355 - protein, 259 aa, Artificial Sequence
  Description of Artificial Sequence: Synthetic single chain variable fragment sequence
QSALTQPASVSGSPGQSITISCTGTSSDVGGYNYVSWYQQHPGKAPKLMIYDVSKRPSGVSNRFSGSKSGNTASLTISGLQAEDEADYYCSSYTRSSTEVFGGGTKLTVLGSRGGGGSGGGGSGGGGSLEMAEVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGGSKKWSGEKWRRENFDYWGQGTLVTVSS

SEQ ID NO: 6356 - protein, 244 aa, Artificial Sequence
  Description of Artificial Sequence: Synthetic single chain variable fragment sequence
SYVLTQPPSASGTPGQRVTISCSGSSSNIGSNTVNWYQQLPGTAPKLLIYRNNQRPSGVPDRFSGSKSGTSASLAISGLRSEDEADYYCAAWDDSLSGLFGTGTKVTVLGSRGGGGSGGGGSGGGGSLEMAQMQLVQSGAEVKKPGASVKVSCKASEYTFTRHILHWVRQAPGQSLEWMGWINPGNGNTKYSQKFQVRVTFTRDTSASTVYMELSSLRSEDTAVYYCARLPDQWGQGTLVTVSS

SEQ ID NO: 6357 - protein, 247 aa, Artificial Sequence
  Description of Artificial Sequence: Synthetic single chain variable fragment sequence
QSALTQPPSASGSPGQSVTISCTGTSRDAGGYNYFSWYQQHPGKAPKLLIYEVTKRPSGVPDRFSGSKSGKTASLTVSGLQADDEAVYYCSSYGGSNNFRVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKQDYWGQGTLVTVSS

SEQ ID NO: 6358 - protein, 248 aa, Artificial Sequence
  Description of Artificial Sequence: Synthetic single chain variable fragment sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGSRGGGGSGGGGSGGGGSLEMAEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSS

SEQ ID NO: 6359 - protein, 250 aa, Artificial Sequence
  Description of Artificial Sequence: Synthetic single chain variable fragment sequence
QSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGSRGGGGSGGGGSGGGGSLEMAEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSS

SEQ ID NO: 6360 - protein, 246 aa, Artificial Sequence
  Description of Artificial Sequence: Synthetic single chain variable fragment sequence
QSVLTQPASVSGSPGQSLTISCTGTSNDVGAYKYVSWYQQYPGKAPKLILYDVFKRPSGVSNRFSGSKSDNTASLTISGLQAEDEADYYCFSLTSSNTYVFGTGTKVTVLGSRGGGGSGGGGSGGGGSLEMAQMQLVQSGAEVKKPGASVKVSCKASGYTFNRYAITWVRQAPGQGLEWMGWISAYNGNSHYAQKLQGRVTMTTDTSTGTAYMELRRLRSDDTAVYYCARMAYDSWGQGTLVTVSS

SEQ ID NO: 6361 - protein, 249 aa, Artificial Sequence
  Description of Artificial Sequence: Synthetic single chain variable fragment sequence
QSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGSRGGGGSGGGGSGGGGSLEMAEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSS

SEQ ID NO: 6362 - protein, 250 aa, Artificial Sequence
  Description of Artificial Sequence: Synthetic single chain variable fragment sequence
SSELTQDPAVSVALGQTVRITCQGDSLRSYYASWYQQKPGQAPVLVIYGKNNRPSGIPDRFSGSSSGNTASLTITGAQAEDEADYYCNSRDSSGNPPVVFGGGTKLTVLGSRGGGGSGGGGSGGGGSLEMAQVQLVESGGGLVHPGGSLRLSCAASGFTFRSHSMNWVRQAPGKGLEWVSSISSDSTYTYYADSVKGRFTISRDNAKNSLYLQMNSLRAEDTAVYYCARSGGQWKYYDYWGQGTLVTVSS

SEQ ID NO: 6363 - protein, 248 aa, Artificial Sequence
  Description of Artificial Sequence: Synthetic single chain variable fragment sequence
QSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGSRGGGGSGGGGSGGGGSLEMAEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTV

SEQ ID NO: 6364 - protein, 248 aa, Artificial Sequence
  Description of Artificial Sequence: Synthetic single chain variable fragment sequence
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNTLVFGGGTKLTVLGSRGGGGSGGGGSGGGGSLEMAQMQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARAGMGMDTWGQGTLVTVSS

SEQ ID NO: 6365 - protein, 249 aa, Artificial Sequence
  Description of Artificial Sequence: Synthetic single chain variable fragment sequence
QSALTQPPSASGSPGQSVTISCTGTSSDIGGYNYVSWYQQHPGKAPKLMIYEVNKRPSGVPDRFSGSKSGNTASLTVSGLQAEDEADYYCASFAGRKTLVFGGGTKLTVLGSRGGGGSGGGGSGGGGSLEMAQVQLVQSGAEVKKPGASVKVSCRASGYTFTAYSLHWVRQAPGQGLEWMGWINPSSGGAVYAQKFQGRVTMTRDTSISTAYMELSGLRSDDTAVYYCARNVGGQADDWGQGTLVTVSS

SEQ ID NO: 6366 - protein, 249 aa, Artificial Sequence
  Description of Artificial Sequence: Synthetic single chain variable fragment sequence
QSALTQPPSASGSPGQSVTISCTGTSTDIGGYNYVSWYQHHPSKAPKLMIYEVNKRPSGVPDRFSGSKSGNTASLTVSGLQAEDEADYYCASFAGRKTLVFGGGTKLTVLGSRGGGGSGGGGSGGGGSLEMAQVQLVQSGAEVKKPGASVKVSCRASGYTFTAYSLHWVRQAPGQGLEWMGWINPSSGGAVYAQKFQGRVTMTRDTSISTAYMELSGLRSDDTAVYYCARNVGGHADDWGQGTLVTVSS

SEQ ID NO: 6367 - protein, 261 aa, Artificial Sequence
  Description of Artificial Sequence: Synthetic single chain variable fragment sequence
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSGVVFGGGTKLTVLGSRGGGGSGGGGSGGGGSLEMAQVQLVQSGGEVKKPGASVKVSCKASGFTFNTYGISWVRQAPGQGLEWMGWISANNGHTKSAQRFQDRVAMATDTSTSTAYMELRSLKFDDTAVYYCARGGYHHQMQRYYKATSVYSDYWGQGTLVTVSS

SEQ ID NO: 6368 - protein, 248 aa, Artificial Sequence
  Description of Artificial Sequence: Synthetic single chain variable fragment sequence
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNTLVFGGGTKLTVLGSRGGGGSGGGGSGGGGSLEMAQMQLVQSGAEVKKPGASVKVSCKASGYTFTSYYMHWVRQAPGQGLEWMGIINPSGGSSSYAQKFQGRVTMTRDTSTSTVYMELSSLRSEDTAVYYCARAGMGMDTWGQGTLVTVSS

SEQ ID NO: 6369 - protein, 249 aa, Artificial Sequence
  Description of Artificial Sequence: Synthetic single chain variable fragment sequence
QSALTQPASVSGSPGQSITISCTGTSSDVGGYNYVSWYQQSPGKAPRLMIYGVSKRPSGVPDRFSGSKSGNTASLTVSGLQAEDEADYYCSSYAGVNNLMFGGGTKLTVLGSRGGGGSGGGGSGGGGSLEMAQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDVISGFDSWGQGTLVTVSS

SEQ ID NO: 6370 - protein, 271 aa, Artificial Sequence
  Description of Artificial Sequence: Synthetic single chain variable fragment sequence
MKKTAIAIAVALAGFATVAQAAELQSALTQPPSASGSPGQSVTISCTGTSRDAGGYNYFSWYQQHPGKAPKLLIYEVTKRPSGVPDRFSGSKSGKTASLTVSGLQADDEAVYYCSSYGGSNNFRVFGGGTKLTVLGSRGGGGSGGGGSGGGGSLEMAEVQLVESGGGVVRPGGSLRLSCAASGFTFGDYGMSWVRQAPGKGLEWVSGINWNGGSTGYADSVKGRFTISRDNAKNSLYLQMNSLRAEDTAVYYCARSKQDYWGQGTLVTVSS

SEQ ID NO: 6371 - protein, 277 aa, Artificial Sequence
  Description of Artificial Sequence: Synthetic single chain variable fragment sequence
MKKTAIAIAVALAGFATVAQAAELSYELTQPPSASGTPGQRVSISCSGSSSNIGSNTVNWYQQFPGTAPKLLIHSNNQRPSGVPDRFSGSKSGTSASLAISGPQSEDEADYYCAAWDDSVNGYVFGTGTKVTVLGSRGGGGSGGGGSGGGGSLEMAQLQLQESGGGSVQPGGSLRLSCAASGFTFSNYAMSWVRQAPGKGLEWVSAITNSGRSTYYADSVKGRFTISRDNSKNTLSLQMSSLRAEDTAVYYCARVTHRRYGSTFDSRGQGTLVTVSS

SEQ ID NO: 6372 - protein, 276 aa, Artificial Sequence
  Description of Artificial Sequence: Synthetic single chain variable fragment sequence
MKKTAIAIAVALAGFATVAQAAELQPVLTQPPSASGTPGQRVTISCSGSSSNIGGNTVSWYQQVPGTAPRLLIFRNNQRPPGVPDRFSGSKSGTSASLAISGLRSEDEADYYCAAWDASRQGVFGGGTKLTVLGSRGGGGSGGGGSGGGGSLEMAQVQLVQSGAEVKKPGSSVKVSCKASGGTFRSYAITWVRQAPGQGLEWMGRIIPMLDITNYAQKFQGRVTITADKSTSTAYMELSSLRSEDTAVYYCARTYSRSPFHMEDFWGQGTLVTVSS

SEQ ID NO: 6373 - protein, 270 aa, Artificial Sequence
  Description of Artificial Sequence: Synthetic single chain variable fragment sequence
MKKTAIAIAVALAGFATVAQAAELQSVLTQPPSASGTPGQRVTISCSGSSSNIGSNTVNWYQQLPGTAPKLLIYRNNQRPSGVPDRFSGSKSGTSASLAISGLRSEDEADYYCAAWDDSLSGRVFGGGTKLTVLGSRGGGGSGGGGSGGGGSLEMAEVQLVESGGGLVQPGGSLRLSCAASGFTFSSYAMSWVRQAPGKGLEWVSAISGSGGSTYYADSVKGRFTISRDNAKNTLYLQMNSLRAEDTAVYYCARKYQDVWGQGTLVTVSS

SEQ ID NO: 6374 - protein, 279 aa, Artificial Sequence
  Description of Artificial Sequence: Synthetic single chain variable fragment sequence
MKKTAIAIAVALAGFATVAQAAELQSVLTQPPSVSGAPGQRVTISCTGSSSNIGAGYDVHWYQQLPGRAPKLLIYGNSNRPSGVPDRFSGSKSGTSASLAITGLQAEDEADYYCQSYDSSLRGYVFGTGTKVTVLGSRGGGGSGGGGSGGGGSLEMAQVQLVQSGGGVVQPGRSLRLSCAASGFSFSGTAMHWVRQAPGKGLEWVSTISSTGRSTYYRDSVKGRFTISRDNSKNTLYLQMNSLRGEDTAVYYCARPVSSMTLSIQSDGWGQGTLVTVSS

SEQ ID NO: 6375 - protein, 286 aa, Artificial Sequence
  Description of Artificial Sequence: Synthetic single chain variable fragment sequence
MKKTAIAIAVALAGFATVAQAAELQSVVTQPPSVSAAPGQRVTISCSGGSSNIGNNYVSWFQQLPRTAPKLLIYDNNKRPSGIPDRFSGSKSGTSAALDITVLQTGDEADYYCGTWDSSLRNWVFGGGTKLTVLGSRGGGGSGGGGSGGGGSLEMAQMQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGQKYHSQYSRGGTGGGMTQDMWGQGTLVTVSS

SEQ ID NO: 6376 - protein, 273 aa, Artificial Sequence
  Description of Artificial Sequence: Synthetic single chain variable fragment sequence
MKKTAIAIAVALAGFATVAQAAELQSVLTQPPSASGSPGQSLTISCTGTSSDVGGYNHVSWYQQYPGKAPKLMIYEVTKRPSGVPDRFSGSKSGNTASLTVSGLQAEDEADYYCSSYAGSAHWVFGGGTKLTVLGSRGGGGSGGGGSGGGGSLEMAEVQLVQSGAEVKKPGASVKVSCKASGYTFSRYYIHWVRQAPGQGLEWMGWMNPNSGNTGYAQKFQGRVTMTRNTSISTAYMELSSLRSEDTAVYYCARGRYHVIDYWGQGTLVTVSS

SEQ ID NO: 6377 - protein, 269 aa, Artificial Sequence
  Description of Artificial Sequence: Synthetic single chain variable fragment sequence
MKKTAIAIAVALAGFATVAQAAELQAVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGRVFGTGTKVTVLGSRGGGGSGGGGSGGGGSLEMAQLQLVQSGAEVKKPGSSVKVSCKASGYTFNTYYLHWVRQAPGQGLEWMGRINPNNGGTNYAQKFQGRVTMTRDTSINTAYMELSRLRSDDTAVYYCARSYDYWGQGTLVTVSS

SEQ ID NO: 6378 - protein, 643 aa, Artificial Sequence
  Description of Artificial Sequence: Synthetic single chain variable fragment sequence
EVQLLEQSGAELVRPGALVKLSCKASGFKIKDYFVNWVKQRPEQGLEWIGWIDPENDNSLYGPNFQDKASITADTSSNTGYLQLSGLTSEDTAVYYCALYYGSRGDAMDYWGQGTTVTVSSGGGGSGGGGSGGGGSELVMTQTPSSLSASLGDRVTISCRASQDISNYLNWYQQKPDGTVKLLIYYTSRLHSGVPSRFSGSGSGTDYSLTISNLEQEDIATYFCQQGNTLPLTFGAGTKLEIKSGGGGSEVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLAAADYKDDDDKGSSHHHHHHEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 6379 - protein, 252 aa, Artificial Sequence; identical to SEQ ID NO: 5991
  Description of Artificial Sequence: Synthetic single chain variable fragment sequence

SEQ ID NO: 6380 - protein, 260 aa, Artificial Sequence
  Description of Artificial Sequence: Synthetic single chain variable fragment sequence
DVQITQSPSYLAASPGETITINCRASKSISKYLAWYQEKPGKTNKLLIYSGSTLQSGIPSRFSGSGSGTDFTLTISSLEPEDFAMYYCQQHNEYPYTFGGGTKLEIKRGSTSGSGKPGSGEGSTKGEVMLVESGGGLVKPGGSLKLSCAASGFTFSSYAMSWVRQTPEKRLEWVATITSGGDYTFYPDSVKGRFTISRDNAKNTLYLQMSSRRSEDTAMYYCARHGEIGYGSSAWFAYWGQGTLVTVSAGGGGSGGGGSC

SEQ ID NO: 6381 - protein, 244 aa, Artificial Sequence
  Description of Artificial Sequence: Synthetic single chain variable fragment sequence
QVQLVQSGAEVKKPGASVKVSCKASGYTFSNYGITWVRQAPGQGLEWMGWINNGNTHYAQKFQGRVTMTTDTSTSTAYMELRSLRSDDTAVYYCARDPRGDDEPYWGQGTLVTVSSGGGGSGGGGSGGGGSEIVLTQSPLSLPVTLGQPASISCRSSQNLVYSDGNTYLSWFQQRPGQSPRRLIYKVSNRDSGVPDRFSGSGSGTDFTLKISRVEAEDIGVYYCMQGTHWPPRTFGQGTKVEIK

SEQ ID NO: 6382 - protein, 232 aa, Artificial Sequence
  Description of Artificial Sequence: Synthetic single chain variable fragment sequence
QVQLVQSGAEVKEPGSSVKVSCKASGGTFSSYAIYWVRQAPGQGLEWMGWINPDSGDTNSAQQFQGRVTMTRDTSISTAYMELSRLRSDDTAMYYCARPPRGDGPDYWGQGTLVTVSSGGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVDIK

SEQ ID NO: 6383 - protein, 255 aa, Artificial Sequence
  Description of Artificial Sequence: Synthetic single chain variable fragment sequence
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKGSTSGSGKPGSGEGSTKGQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGGSGGGGSC

SEQ ID NO: 6384 - protein, 255 aa, Artificial Sequence; identical to SEQ ID NO: 6383
  Description of Artificial Sequence: Synthetic single chain variable fragment sequence

SEQ ID NO: 6385 - protein, 511 aa, Artificial Sequence
  Description of Artificial Sequence: Synthetic single chain variable fragment sequence
METDTLLLWVLLLWVPAGNGEVQLVESGGGLVQPGGSLRLSCSFSGFSLSTSGMGVSWVRQAPGKGLEWLAHIYWDDDKRYNPSLKSRFTISRDNSKNTVYLQMNSLRAEDTAVYYCARRETVFYWYFDVWGQGTTVTVSSGGGGSGGGGSGGGTGDIVMTQSPDSLAVSLGDRATINCKASQSVDYDGDSYMNWYQQKPGQPPKLLIYAASNLESGVPDRFSGSGSGTDFTLTISSLQAEDVAVYYCQQSNEDPPTFGGGTKVEISSSSGSDKTHTCPPCPAPELLGGPSVFLFPPKPKDTLMISRTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSSSSSSAWSHPQFEK

SEQ ID NO: 6386 - protein, 506 aa, Artificial Sequence
  Description of Artificial Sequence: Synthetic single chain variable fragment sequence
METDTLLLWVLLLWVPAGNGEVQLVESGGGLVKPGGSLRLSCAASGFTFNTNAMNWVRQAPGKGLEWVARIRSKSNNYATYYADSVKDRFTLSRDDSKNTLYLQMNSLKTEDTAVYYCTRDRGWGAMDYWGQGTTVTVSSGGGGSGGGGSGGGTGDIQMTQSPSSLSASVGDRVTITCSASQDINNYLNWYQQKPGKAPKLLIYYTSSLHSGVPSRFSGSGSGTDFTLTLSSLQPEDFATYYCQQFSNLPWTFGGGTKLEISSSSGSDKTHTCPPCPAPELLGGPSVFLFPPKPKDTLMISRTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSSSSSSAWSHPQFEK

SEQ ID NO: 6387 - protein, 508 aa, Artificial Sequence
  Description of Artificial Sequence: Synthetic single chain variable fragment sequence
VLTQTPSPVSAAVGGTVTINCQSSPSLIYDSRLAWYQQKPGQPPKLLIYKASTLASGVPSRFSGSGSGTQFTLTISDVQSDDAATYYCQSHDTNPGSSTYGAPFGGGTEVVVQGGGGSGGGGSSGGGSEVQLMESGGGLVKPEGSLTLTCKVSGFSFSTSAISWVRQAPGKRPEWIAGIYNGGGSTYYASWVNGRFSISRSTSLNTVTLQMTRLTAADTATYFCARWIRIHYSFDLWGPGTLVTVSSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 6388 - protein, 262 aa, Artificial Sequence
  Description of Artificial Sequence: Synthetic single chain variable fragment sequence
QVQLQESGPGLVKPSETLSLTCTVSGGSVSSGSYYWSWIRQPPGKGLEWIGYIYYSGSTNYNPSHKSRVTISVDTSKNQFSLKLSSVTAADTAVYYCAREGKNGAFDIWGQGTMVTVSSSGGGGSGGGGSGGGGERHQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKGQAGHHHHHHGDYKDDDDKG

SEQ ID NO: 6389 - protein, 243 aa, Artificial Sequence
  Description of Artificial Sequence: Synthetic single chain variable fragment sequence
QVQLQQSGAEVKKPGASVKVSCKASGYTFTGYYMHWVRQAPGQGLEWMGINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIK

SEQ ID NO: 6390 - protein, 239 aa, Artificial Sequence
  Description of Artificial Sequence: Synthetic single chain variable fragment sequence
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 6391 - protein, 240 aa, Artificial Sequence
  Description of Artificial Sequence: Synthetic single chain variable fragment sequence
QVQLQQSGAEVKKPGASVKVSCKASGYTFTGYYMHWVRQAPGQGLEWMGINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 6392 - protein, 252 aa, Artificial Sequence
  Description of Artificial Sequence: Synthetic single chain variable fragment sequence
QVQLVQSGAEVKKPGASVKVSCKASGYTFTGYYMHWVRQAPGQGLEWMGINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 6393 - protein, 245 aa, Artificial Sequence
  Description of Artificial Sequence: Synthetic single chain variable fragment sequence
QVQLVQSGAEVKKPGAPVKVSCKASGYTFTGYYMHWVRQAPGQGLEWMGINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 6394 - protein, 241 aa, Artificial Sequence
  Description of Artificial Sequence: Synthetic single chain variable fragment sequence
QVQLVESGGGLVQPGGSLRLSCAASGFTFSSYWMHWVRQVPGKGLVWVSINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 6395 - protein, 240 aa, Artificial Sequence
  Description of Artificial Sequence: Synthetic single chain variable fragment sequence
QVQLVQSGAEVEKPGASVKVSCKASGYTFTDYYMHWVRQAPGQGLEWMGINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 6396 - protein, 249 aa, Artificial Sequence
  Description of Artificial Sequence: Synthetic single chain variable fragment sequence
QVQLVQSGGGVVQPGRSLRLSCAASGFTFSSYAMHWVRQAPGKGLEWVAISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 6397 - protein, 245 aa, Artificial Sequence
  Description of Artificial Sequence: Synthetic single chain variable fragment sequence
QVQLQQSGAEVKKPGASVKVSCKTSGYPFTGYSLHWVRQAPGQGLEWMGINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 6398 - protein, 248 aa, Artificial Sequence
  Description of Artificial Sequence: Synthetic single chain variable fragment sequence
QVQLVQSGAEVKKPGASVEVSCKASGYTFTSYYMHWVRQAPGQGLEWMGLINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 6399 - protein, 254 aa, Artificial Sequence
  Description of Artificial Sequence: Synthetic single chain variable fragment sequence
QVQLVQSGAEVKKPGASVKVSCKASGYTFTSYGISWVRQAPGQGLEWMGISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 6400 - protein, 245 aa, Artificial Sequence
  Description of Artificial Sequence: Synthetic single chain variable fragment sequence
QVQLVQSGAEVKKPGASVKVSCKASGYTFTGYYMHWVRQAPGQGLEWMGINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 6401 - protein, 249 aa, Artificial Sequence
  Description of Artificial Sequence: Synthetic single chain variable fragment sequence
QVQLVQSGGGLVKPGGSLRLSCEASGFIFSDYYMGWIRQAPGKGLEWVSIIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 6402 - protein, 245 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 6403 - protein, 250 aa, Artificial Sequence
  Description of Artificial Sequence: Synthetic single chain variable fragment sequence
QVQLVQSGGGLVQPGGSLRLSCAASGFTFSSYWMHWVRQAPGKGLVWVSINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 6404 - protein, 249 aa, Artificial Sequence
  Description of Artificial Sequence: Synthetic single chain variable fragment sequence
QVQLVQSGGGVVQPGRSLRLSCAASGFTFSSYGMHWVRQAPGKGLEWVAISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 6405 - protein, 248 aa, Artificial Sequence
  Description of Artificial Sequence: Synthetic single chain variable fragment sequence
QVQLVQSGGGLVQPGGSLRLSCAASGFTFSSYAMSWVRQAPGKGLEWVSISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 6406 - protein, 247 aa, Artificial Sequence
  Description of Artificial Sequence: Synthetic single chain variable fragment sequence
QVQLVQSWAEVKKPGASVKVSCKASGYTFTSYYMHWVRQAPGQGLEWMGLINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIK

SEQ ID NO: 6407 - protein, 252 aa, Artificial Sequence
  Description of Artificial Sequence: Synthetic single chain variable fragment sequence
QVQLVQSGAEVRRPGASVKISCRASGDTSTRHYIHWLRQAPGQGPEWMGINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIK

SEQ ID NO: 6408 - protein, 249 aa, Artificial Sequence
  Description of Artificial Sequence: Synthetic single chain variable fragment sequence
QVQLQQSGAEVKKPGASVKVSCKASGYTFTNYYMHWVRQAPGQGLEWMGLINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 6409 - protein, 262 aa, Artificial Sequence; identical to SEQ ID NO: 6388
  Description of Artificial Sequence: Synthetic single chain variable fragment sequence

SEQ ID NO: 6410 - protein, 246 aa, Artificial Sequence
  Description of Artificial Sequence: Synthetic single chain variable fragment sequence
QITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIK

SEQ ID NO: 6411 - protein, 251 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGLINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVASVGDRVTITCRASQGVGRWLAWYQQKPGTAPKLLIYAASTLQGVPSRFSGSGSGTDFTLTINNLQPEDFATYYCQQANSFPLTFGGGTRLEIK

SEQ ID NO: 6412 - protein, 249 aa, Artificial Sequence
  Description of Artificial Sequence: Synthetic single chain variable fragment sequence
QVQLVQSGAEVRAPGASVKISCKASGFTFRGYYIHWVRQAPGQGLEWMGLINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 6413 - protein, 243 aa, Artificial Sequence
  Description of Artificial Sequence: Synthetic single chain variable fragment sequence
QVQLVQSGGGLVQPGRSLRLSCAASGFTFDDYAMHWVRQAPGKGLEWVSISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 6414 - protein, 245 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 6415 - protein, 267 aa, Artificial Sequence
  Description of Artificial Sequence: Synthetic single chain variable fragment sequence
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIKAA

SEQ ID NO: 6416 - protein, 265 aa, Artificial Sequence
  Description of Artificial Sequence: Synthetic single chain variable fragment sequence
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIK

SEQ ID NO: 6417 - protein, 268 aa, Artificial Sequence
  Description of Artificial Sequence: Synthetic single chain variable fragment sequence
MVLLVTSLLLCELPHPAFLLIPDIQAQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 6418 - protein, 259 aa, Artificial Sequence
  Description of Artificial Sequence: Synthetic single chain variable fragment sequence
QVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLS

SEQ ID NO: 6419 - protein, 493 aa, Artificial Sequence
  Description of Artificial Sequence: Synthetic single chain variable fragment sequence
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6420 - protein, 487 aa, Artificial Sequence
  Description of Artificial Sequence: Synthetic single chain variable fragment sequence
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEFMYPPPYLDNERSNGTIIHIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 6421 - protein, 493 aa, Artificial Sequence; identical to SEQ ID NO: 6419
  Description of Artificial Sequence: Synthetic single chain variable fragment sequence

SEQ ID NO: 6422 - protein, 487 aa, Artificial Sequence; identical to SEQ ID NO: 6420
  Description of Artificial Sequence: Synthetic single chain variable fragment sequence

SEQ ID NO: 6423 - protein, 252 aa, Artificial Sequence
  Description of Artificial Sequence: Synthetic single chain variable fragment sequence
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRGSTSGSGKPGSGEGSTKGQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSSSGGGGSGGGGSC

SEQ ID NO: 6424 - protein, 252 aa, Artificial Sequence; identical to SEQ ID NO: 6423
  Description of Artificial Sequence: Synthetic single chain variable fragment sequence

SEQ ID NO: 6425 - protein, 241 aa, Artificial Sequence
  Description of Artificial Sequence: Synthetic single chain variable fragment sequence
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIK

SEQ ID NO: 6426 - protein, 241 aa, Artificial Sequence; identical to SEQ ID NO: 6425
  Description of Artificial Sequence: Synthetic single chain variable fragment sequence

SEQ ID NO: 6427 - protein, 114 aa, Artificial Sequence; identical to SEQ ID NO: 5053
  Description of Artificial Sequence: Synthetic single chain variable fragment sequence

SEQ ID NO: 6428 - protein, 112 aa, Artificial Sequence; identical to SEQ ID NO: 3060
  Description of Artificial Sequence: Synthetic single chain variable fragment sequence

SEQ ID NO: 6429 - protein, 47 aa, Artificial Sequence
  Description of Artificial Sequence: Synthetic single chain variable fragment sequence
EVKLVESGGGLVLPGDSLRLSCATSEFTFTDYYMTWVRQPPRKALEW

SEQ ID NO: 6430 - protein, 112 aa, Artificial Sequence
  Description of Artificial Sequence: Synthetic single chain variable fragment sequence
DVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIK

SEQ ID NO: 6431 - protein, 219 aa, Artificial Sequence
  Description of Artificial Sequence: Synthetic single chain variable fragment sequence
DIQMTQSPDSLPVTPGEPASISCRSSQSLLHSNGYNYLDWYLQKAGQSPQLLIYLGSNRASGVPDRFSGSGSGTDFTLKISRVEAEDVGVYYCQQYYNHPTTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6432 - protein, 240 aa, Artificial Sequence
  Description of Artificial Sequence: Synthetic single chain variable fragment sequence
QVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTK

SEQ ID NO: 6433 - protein, 253 aa, Artificial Sequence
  Description of Artificial Sequence: Synthetic single chain variable fragment sequence
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 6434 - protein, 246 aa, Artificial Sequence
  Description of Artificial Sequence: Synthetic single chain variable fragment sequence
QVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 6435 - protein, 242 aa, Artificial Sequence
  Description of Artificial Sequence: Synthetic single chain variable fragment sequence
QVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 6436 - protein, 241 aa, Artificial Sequence
  Description of Artificial Sequence: Synthetic single chain variable fragment sequence
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 6437 - protein, 253 aa, Artificial Sequence
  Description of Artificial Sequence: Synthetic single chain variable fragment sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIK

SEQ ID NO: 6438 - protein, 250 aa, Artificial Sequence
  Description of Artificial Sequence: Synthetic single chain variable fragment sequence
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 6439 - protein, 246 aa, Artificial Sequence
  Description of Artificial Sequence: Synthetic single chain variable fragment sequence
QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 6440 - protein, 248 aa, Artificial Sequence
  Description of Artificial Sequence: Synthetic single chain variable fragment sequence
QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 6441 - protein, 255 aa, Artificial Sequence
  Description of Artificial Sequence: Synthetic single chain variable fragment sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 6442 - protein, 241 aa, Artificial Sequence
  Description of Artificial Sequence: Synthetic single chain variable fragment sequence
QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 6443 - protein, 246 aa, Artificial Sequence
  Description of Artificial Sequence: Synthetic single chain variable fragment sequence
QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 6444 - protein, 249 aa, Artificial Sequence
  Description of Artificial Sequence: Synthetic single chain variable fragment sequence
QVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 6445 - protein, 249 aa, Artificial Sequence
  Description of Artificial Sequence: Synthetic single chain variable fragment sequence
QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 6446 - protein, 244 aa, Artificial Sequence
  Description of Artificial Sequence: Synthetic single chain variable fragment sequence
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 6447 - protein, 246 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 6448 - protein, 246 aa, Artificial Sequence
  Description of Artificial Sequence: Synthetic single chain variable fragment sequence
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 6449 - protein, 251 aa, Artificial Sequence
  Description of Artificial Sequence: Synthetic single chain variable fragment sequence
QVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 6450 - protein, 250 aa, Artificial Sequence
  Description of Artificial Sequence: Synthetic single chain variable fragment sequence
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 6451 - protein, 249 aa, Artificial Sequence
  Description of Artificial Sequence: Synthetic single chain variable fragment sequence
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 6452 - protein, 247 aa, Artificial Sequence
  Description of Artificial Sequence: Synthetic single chain variable fragment sequence
QVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIK

SEQ ID NO: 6453 - protein, 253 aa, Artificial Sequence
  Description of Artificial Sequence: Synthetic single chain variable fragment sequence
QVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIK

SEQ ID NO: 6454 - protein, 249 aa, Artificial Sequence
  Description of Artificial Sequence: Synthetic single chain variable fragment sequence
QVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 6455 - protein, 262 aa, Artificial Sequence
  Description of Artificial Sequence: Synthetic single chain variable fragment sequence
FGLRWVFLVAILKGVQCEVQLLESGGGLVQPGGSLRLSCAASGFTFSNFGMTWVRQAPGKGLEWVSGVSIRGIATYYADSVKGRFTISRDDSRNTLYLQMNSLRAEDTALYYCATGVRLLGREWGQGTLVTVSSGGGGSGGGGSGGGGSDVVMTQSPLSLPVPLGQPASISCRSSQSLVDNDGNTYLNWFQQRPGQSPRRLIYKVSMRDSGVPDRFTGSGSGTDFTLRISRVEADDVGVYYCMQGTHWPLTFGPGTKVEIKR

SEQ ID NO: 6456 - protein, 111 aa, Artificial Sequence
  Description of Artificial Sequence: Synthetic single chain variable fragment sequence
EVQLVESGGGLVQAGGSLTISCAASGITFSDSIVSWYRRARGKQREWVAGISNGGTTKYAESVLGRFTISRDNAKNMVYLQMNGLNPEDTAVYLCKVRQYWGQGTQVTVSS

SEQ ID NO: 6457 - protein, 114 aa, Artificial Sequence
  Description of Artificial Sequence: Synthetic single chain variable fragment sequence
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 6458 - protein, 126 aa, Artificial Sequence
  Description of Artificial Sequence: Synthetic single chain variable fragment sequence
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 6459 - protein, 123 aa, Artificial Sequence
  Description of Artificial Sequence: Synthetic single chain variable fragment sequence
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 6460 - protein, 124 aa, Artificial Sequence
  Description of Artificial Sequence: Synthetic single chain variable fragment sequence
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 6461 - protein, 115 aa, Artificial Sequence
  Description of Artificial Sequence: Synthetic single chain variable fragment sequence
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 6462 - protein, 120 aa, Artificial Sequence
  Description of Artificial Sequence: Synthetic single chain variable fragment sequence
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 6463 - protein, 119 aa, Artificial Sequence
  Description of Artificial Sequence: Synthetic single chain variable fragment sequence
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 6464 - protein, 114 aa, Artificial Sequence
  Description of Artificial Sequence: Synthetic single chain variable fragment sequence
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 6465 - protein, 127 aa, Artificial Sequence
  Description of Artificial Sequence: Synthetic single chain variable fragment sequence
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 6466 - protein, 113 aa, Artificial Sequence
  Description of Artificial Sequence: Synthetic single chain variable fragment sequence
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 6467 - protein, 118 aa, Artificial Sequence
  Description of Artificial Sequence: Synthetic single chain variable fragment sequence
  MOD_RES (27)..(27): Any amino acid
  MOD_RES (32)..(32): Any amino acid
  MOD_RES (75)..(75): Any amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 6468 - protein, 250 aa, Artificial Sequence
  Description of Artificial Sequence: Synthetic single chain variable fragment sequence
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGSYVFGTGTKVTVLGSRGGGGSGGGGSGGGGSLEMAQVQLVQSGAEVRKPGASVKVSCKASGGTFSSYAISWVRQAPGQGLEWMGRIIPILGIANYAQKFQGRVTITADKSTSTAYMELSSLRSEDTAVYYCARHYGQWWDYWGQGTLVTVSS

SEQ ID NO: 6469 - protein, 249 aa, Artificial Sequence
  Description of Artificial Sequence: Synthetic single chain variable fragment sequence
QSVVTQPPAVSGALGQRVTISCTGTTSNIGAGFDVHWYQQRPGAAPKLLISGNTHRPSGVPDRISGSKSGTLASLAITGLQAEDEADYYCQSYDRSLSTILFGGGTKLTVLGSRGGGGSGGGGSGGGGSLEMAQVQLVQSGAEVKKPGSSVKVSCKASGGTFSSHPISWVRQAPGQGLEWMGRIIPMLDIPNNAQKFQGRVTITADKSTDTAYLELSSLTSEDTAVYYCARGLYYYDYWGQGTLVTVSS

SEQ ID NO: 6470 - protein, 249 aa, Artificial Sequence
  Description of Artificial Sequence: Synthetic single chain variable fragment sequence
QSVLTQPPSVSGAPGQRVTISCTGSSSNIGAGFDVHWYQQLPGTAPKLLIFGNSNRPSGVPDRFSGSKSGTSASLAITGLQAEDEADYYCQSYDSSLSGYVFGSGTKVTVLGSRGGGGSGGGGSGGGGSLEMAEVQLVESGAEVKKPGSSVKVSCKASGGTFSSYAISWVRQAPGQGLEWMGRIIPIFGIANYAQKFQGRVTITADKSTSTAYMELSSLRSEDTAVYYCARSMWYMDSWGQGTLVTVSS

SEQ ID NO: 6471 - protein, 247 aa, Artificial Sequence
  Description of Artificial Sequence: Synthetic single chain variable fragment sequence
DIQLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIKRSRGGGGSGGGGSGGGGSLEMAQVQLVQSGAEVKKPGASVKVSCKASGYTFSSYGISWVRQAPGQGLEWMGWISPYNGNTNYAQNLQGRVTMTTDTSTTTAYMELRSLTSDDTAVYYCARYSGYYYVDYWGQGTLVTVSS

SEQ ID NO: 6472 - protein, 251 aa, Artificial Sequence
  Description of Artificial Sequence: Synthetic single chain variable fragment sequence
KLLPVLTQPPSVSVAPGKTARITCGGNNIGSKSVHWYQQKPGQAPVLVIYYDSDRPSGIPERFSGSNSGNTATLTISRVEAGDEADYYCQVWDSITDHYVFGTGTKVTVLGSRGGGGSGGGGSGGGGSLEMAEVQLVESGAEVKKPGSSVKVSCKASGGTFSSYAISWVRQAPGQGLEWMGRIIPILGIANYAQKFQGRVTITADKSTSTAYMELSSLRSEDTAVYYCARQGYVWSEMDFWGQGTLVTVSS

SEQ ID NO: 6473 - protein, 251 aa, Artificial Sequence
  Description of Artificial Sequence: Synthetic single chain variable fragment sequence
KLLPVLTQPHSVSESPGKTVTISCTGSSGSIASNFVQWYQQRPGSAPTTVIYDDNQRPSGVPDRFSASIDRSSNSASLTISGLKTDDEADYYCQSYDGSNVIFGGGTKLTVLGSRGGGGSGGGGSGGGGSLEMAEVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCAAGSYYSLDIWGQGTMVTVSS

SEQ ID NO: 6474 - protein, 247 aa, Artificial Sequence
  Description of Artificial Sequence: Synthetic single chain variable fragment sequence
QPVLTQPPSVSVAPGETASVSCGGNNFGSQSVHWYQQKSGQAPLLVIYYDQDRPSEIPARFSGSKSGNTATLTISRVEAGDEADYYCQVWDTYTDHVVFGGGTKLTVLGSRGGGGSGGGGSGGGGSLEMAEVQLVQSGAEVEKPGASVKVSCKASGYTFSSYYMDWVRQAPGQGLEWMGRINPTSGSTTYAQKFQGRVTMTRDTSTFTVYMDLSSLRSEDTAVYYCARSGGGYGDSWGQGTLVTVSS

SEQ ID NO: 6475 - protein, 245 aa, Artificial Sequence
  Description of Artificial Sequence: Synthetic single chain variable fragment sequence
EIQLQQSGPELVKPGASVKMSCKASGYTFTDYYMHWVKQNNGESLEWIGYFNPYNDYTRYNQNFNGKATLTVDKSSSTAYMQLNSLTSEDSAFYYCARSDGYYDAMDYWGQGTSVTVSSGGGGSGGGGSSGGGGSDVQITQSPSYLAASPGETITINCRASKSISKYLAWYQEKPGKANKLLIHSGSTLQSGIPSRFSGSGSGTDFTLTISSLEPEDFAMYYCQQHIEYPWTFGGGTKLEIKRAS

SEQ ID NO: 6476 - protein, 244 aa, Artificial Sequence
  Description of Artificial Sequence: Synthetic single chain variable fragment sequence
DVQITQSPSYLAASPGETITINCRASKSISKYLAWYQEKPGKANKLLIHSGSTLQSGIPSRFSGSGSGTDFTLTISSLEPEDFAMYYCQQHIEYPWTFGGGTKLEIKRAGGGGSGGGGSSGGGGSEIQLQQSGPELVKPGASVKMSCKASGYTFTDYYMHWVKQNNGESLEWIGYFNPYNDYTRYNQNFNGKATLTVDKSSSTAYMQLNSLTSEDSAFYYCARSDGYYDAMDYWGQGTSVTVSS

SEQ ID NO: 6477 - protein, 242 aa, Artificial Sequence
  Description of Artificial Sequence: Synthetic single chain variable fragment sequence
DIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRGGGGSGGGGSGGGGSEVQLVQSGAEVKKPGATVKISCKASGYTFTDYYMHWVQQAPGKGLEWMGYFNPYNDYTRYAEKFQGRVTITADTSTDTAYMELSSLRSEDTAVYYCARSDGYYDAMDYWGQGTTVTVSS

SEQ ID NO: 6478 - protein, 242 aa, Artificial Sequence
  Description of Artificial Sequence: Synthetic single chain variable fragment sequence
DIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRGGGGSGGGGSGGGGSQVQLVQSGAEVKKPGASVKVSCKASGYTFTDYYMHWVRQAPGQGLEWMGYFNPYNDYTRYAQKFQGRVTMTRDTSISTAYMELSSLRSDDTAVYYCARSDGYYDAMDYWGQGTTVTVSS

SEQ ID NO: 6479 - protein, 244 aa, Artificial Sequence
  Description of Artificial Sequence: Synthetic single chain variable fragment sequence
EVQLVQSGAEVKKPGATVKISCKASGYTFTDYYMHWVQQAPGKGLEWMGYFNPYNDYTRYAEKFQGRVTITADTSTDTAYMELSSLRSEDTAVYYCARSDGYYDAMDYWGQGTTVTVSSGGGGSGGGGSGGGGSDIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRAS

SEQ ID NO: 6480 - protein, 244 aa, Artificial Sequence
  Description of Artificial Sequence: Synthetic single chain variable fragment sequence
QVQLVQSGAEVKKPGASVKVSCKASGYTFTDYYMHWVRQAPGQGLEWMGYFNPYNDYTRYAQKFQGRVTMTRDTSISTAYMELSSLRSDDTAVYYCARSDGYYDAMDYWGQGTTVTVSSGGGGSGGGGSGGGGSDIQMTQSPSAMSASVGDRVTITCRASKSISKYLAWFQQKPGKVPKLRIHSGSTLQSGVPSRFSGSGSGTEFTLTISSLQPEDFATYYCQQHIEYPWTFGQGTKVEIKRAS

SEQ ID NO: 6481 - protein, 250 aa, Artificial Sequence
  Description of Artificial Sequence: Synthetic single chain variable fragment sequence
METDTLLLWVLLLWVPGSTGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSSGGGGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKGGC

SEQ ID NO: 6482 - protein, 253 aa, Artificial Sequence
  Description of Artificial Sequence: Synthetic single chain variable fragment sequence
METDTLLLWVLLLWVPGSTGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSGGGSGGGGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKGGC

SEQ ID NO: 6483 - protein, 250 aa, Artificial Sequence
  Description of Artificial Sequence: Synthetic single chain variable fragment sequence
METDTLLLWVLLLWVPGSTGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKSGGGGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSGGC

SEQ ID NO: 6484 - protein, 253 aa, Artificial Sequence
  Description of Artificial Sequence: Synthetic single chain variable fragment sequence
METDTLLLWVLLLWVPGSTGDIVMTQSPSSLSASVGDRVTITCKASQDVGTAVDWYQQKPGKAPKLLIYWASTRHTGVPDRFTGSGSGTDFTLTISSLQPEDFADYFCQQYNSYPLTFGGGTKLEIKGGGSGGGGEVQLVQSGAEVKKPGASVKISCKTSGYTFTEYTIHWVKQASGKGLEWIGNINPNNGGTTYNQKFEDRATLTVDKSTSTAYMELSSLRSEDTAVYYCAAGWNFDYWGQGTTVTVSSGGC

SEQ ID NO: 6485 - protein, 265 aa, Artificial Sequence
  Description of Artificial Sequence: Synthetic single chain variable fragment sequence
MAQVQLQESGPGLVKPSQSLSLTCSVTGYSITSNYWGWIRKFPGNKMEWMGYISYSGSTSYNPSLKSRISITRDTSKNQLFLQLNSVTTEDTATYYCARYSLFNYGRRDYVMDAWGQGTTVTVSSGGGGSGGGGSGGGGSDIELTQSPATMAASPGEKVTITCRASSTVSYMHWFQQKPGASPKPWIYDTSKLASGVPDRFSGSGSGTDFTLTIDPVQADDIATYYCQQSKDDPRTFGGGTKLELKRRPQVRRCRIRIRWNRVPH

SEQ ID NO: 6486 - protein, 261 aa, Artificial Sequence
  Description of Artificial Sequence: Synthetic single chain variable fragment sequence
MAQVKLQQSGPELVKPGASVKMSCKASGYTFTSYVMHWVKQSNGKSLEWIGTIDPYYGGTSYNQKFKGKATLTVDKSSTTAYIQLKSLTSEDSAVYYCARWDGYYGGFSYWGQGTMVTVSSGGGGSGGGGSGGGGSDIELTQSPAIMSATLGEKVTMSCRASSNVKYMYWYQQKSGASPKLWIYYTSNLASGVPARFSGSGSGTSYSLTISSVEAEDAATYYCQQFTSSPYTFGSGTKLEIKRAAAGAPVPYPDPLEPRAA

SEQ ID NO: 6487 - protein, 260 aa, Artificial Sequence
  Description of Artificial Sequence: Synthetic single chain variable fragment sequence
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRGSTSGSGKPGSGEGSTKGEVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSGGGGSGGGGSC

SEQ ID NO: 6488 - protein, 260 aa, Artificial Sequence; identical to SEQ ID NO: 6487
  Description of Artificial Sequence: Synthetic single chain variable fragment sequence

SEQ ID NO: 6489 - protein, 251 aa, Artificial Sequence
  Description of Artificial Sequence: Synthetic single chain variable fragment sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVLGSRGGGGSGGGGSGGGGSLEMAQVQLVQSGAEVKKPGSSVKVSCKASGGTFSSYAISWVRQAPGQGLEWMGGIIPIFGKGNYPQKFQGRVTITADESTGTAYMELSSLRSEDTAVYYCARHIPTFSFDYWGQGTLVTVSS

SEQ ID NO: 6490 - protein, 257 aa, Artificial Sequence
  Description of Artificial Sequence: Synthetic single chain variable fragment sequence
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRGSTSGSGKPGSGEGSTKGQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGGGGSGGGGSC

SEQ ID NO: 6491 - protein, 257 aa, Artificial Sequence; identical to SEQ ID NO: 6490
  Description of Artificial Sequence: Synthetic single chain variable fragment sequence

SEQ ID NO: 6492 - protein, 265 aa, Artificial Sequence
  Description of Artificial Sequence: Synthetic single chain variable fragment sequence
MALPVTALLLPLALLLHAARPQVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKRSDP

SEQ ID NO: 6493 - protein, 234 aa, Artificial Sequence
  Description of Artificial Sequence: Synthetic single chain variable fragment sequence
  MOD_RES (208)..(208): Any amino acid
  MOD_RES (211)..(211): Any amino acid
  MOD_RES (214)..(214): Any amino acid
QITLKESGGGLVKPGGSLRLSCAASGFTFSNAWMSWVRQAPGKGLEWVGRIRSKTDGGTTDYAALVKGRFTISRDDSENTLYLQMNSLKTEDTAVYYCARDFGRWSYYFDYWSQGTLVTVSSSYELTQPPSVSVSPGQTASITCSGDKLGDKYACWYQQKPGQSPVLVIYQDSKRPSGIPERFSGSNSGNTATLTISGTQAMDEADYXAAXAAXAAAWDSSTVVFGGGTKLTVL

SEQ ID NO: 6494 - protein, 232 aa, Artificial Sequence
  Description of Artificial Sequence: Synthetic single chain variable fragment sequence
  MOD_RES (208)..(208): Any amino acid
  MOD_RES (211)..(211): Any amino acid
QITLKESGGGLVKPGGSLRLSCAASGFTFSNAWMSWVRQAPGKGLEWVGRIRSKTDGGTTDYAALVKGRFTISRDDSENTLYLQMNSLKTEDTAVYYCARDFGRWSYYFDYWSQGTLVTVSSSYELTQPPSVSVSPGQTASITCSGDKLGDKYACWYQQKPGQSPVLVIYQDSKRPSGIPERFSGSNSGNTATLTISGTQAMDEADYXAAXAAQAWDSSTVVFGGGTKLTVL

SEQ ID NO: 6495 - protein, 242 aa, Artificial Sequence
  Description of Artificial Sequence: Synthetic single chain variable fragment sequence
  MOD_RES (187)..(187): Any amino acid
  MOD_RES (209)..(209): Any amino acid
  MOD_RES (218)..(218): Any amino acid
  MOD_RES (221)..(221): Any amino acid
  MOD_RES (224)..(224): Any amino acid
  MOD_RES (227)..(227): Any amino acid
QITLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPPSVSVAPGQTARITCGGNNIGTKSVHWYQQKPGQAPVLVLYDESDRPSGIPERFSGSXAASGNTATLTISRVEAGDEADXAALLSGVGXAAXAAXAAXAASLCFGSGTKLTVL

SEQ ID NO: 6496 - protein, 234 aa, Artificial Sequence
  Description of Artificial Sequence: Synthetic single chain variable fragment sequence
  MOD_RES (187)..(187): Any amino acid
  MOD_RES (209)..(209): Any amino acid
QITLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPPSVSVAPGQTARITCGGNNIGTKSVHWYQQKPGQAPVLVLYDESDRPSGIPERFSGSXAASGNTATLTISRVEAGDEADXAALLQVWDSSSDHYVFGSGTKLTVL

SEQ ID NO: 6497 - protein, 214 aa, Artificial Sequence
  Description of Artificial Sequence: Synthetic single chain variable fragment sequence
  MOD_RES (4)..(4): Any amino acid
  MOD_RES (13)..(13): Any amino acid
RSPXAARSLGEAXAAVKPGGSLRLSCAASGFTFSNAWMSGSAQAPGKGLEWVGRIKSKTDGGTTDYAAPVKGRFTISRDDSKNTLYLQMNSLKTEDTAVYYCARDFGRWSYYFDYWSQGTLVTVSSEIVMTQSPSFLSASVGDRVTITCRASQGISSYLAWYQQKPGKAPKLLIYAASTLQSGSHQGFSGSGSGTEFTLTISSLQPEDFATYYC

SEQ ID NO: 6498 - protein, 210 aa, Artificial Sequence
  Description of Artificial Sequence: Synthetic single chain variable fragment sequence
  MOD_RES (208)..(208): Any amino acid
QVTLKESGGGLVKPGGSLRLSCAASGFTFQRLDEWVRQAPGKGLEWVGRIKSKTDGGTTDYAAPVKGRFTISRDDSKNTLYLQMNSLKTEDTAVYYCARDFGRWSYYFDYWSQGTLVTVSSQSALTQDPAVSVALGTDSQDHMPRRQPQKTIMQWYQQKPGQAPALVIYGKNDRPSGIPDRFSGSTSGNTASLTITGAQAEDEADYYXAA

SEQ ID NO: 6499 - protein, 228 aa, Artificial Sequence
  Description of Artificial Sequence: Synthetic single chain variable fragment sequence
QVQLVESGGGLVKPGGSLRLSCAASGFTFSNAWMSWVRQAPGKGLEWVGRIKSKTDGGTTDYAAPVKGRFTISRDDSKNSLYLQMNSLKTEDTAVYYCARDFGRWSYYFDYWGQGTLVTVSSVLTQPPSVSVAPGKTARITCGGNNLGSKNVHWYQQKPGQAPVLVIYDDDNRPSGIPERFSGSNSGNTATLTISRVEAGDEADYYCQVWDSSSRHVVFGGGTKLTVL

SEQ ID NO: 6500 - protein, 232 aa, Artificial Sequence
  Description of Artificial Sequence: Synthetic single chain variable fragment sequence
QVTLKESGGGLVKPGGSLRLSCAASGFTFSNAWMSWVRQAPGKGLEWVGRIKSKTDGGTTDYAAPVKGRFTISRDDSKNTLYLQMNSLRTEDTAVYYCARDFGRWSYYFDYWSQGTLVTVSSQPVLTQPHSVSESPGKTVTISCTRSSGNIASNFVQWYQRRPDGATTNVIYEDTQRPSGVSGRFSGSIDRSSNSASLTISGLRAEDEADYYCQSYDGRNLMFGGGTKVTVL

SEQ ID NO: 6501 - protein, 232 aa, Artificial Sequence
  Description of Artificial Sequence: Synthetic single chain variable fragment sequence
EVQLVESGGGLVKPGGSLRLSCAASGFTFSNAWMSWVRQAPGKGLEWVGRIKSKTDGGTTDYAAPVKGRFTISRDDSKNTLYLQMNSLRTEDTAVYYCARDFGRWSYYFDYWSQGTLVTVSSQPVLTQPHSVSESPGKTVTISCTRSSGNIASNFVQWYQRRPDGATTNVIYEDTQRPSGVSGRFSGSIDRSSNSASLTISGLRAEDEADYYCQSYDGRNLMFGGGTKVTVL

SEQ ID NO: 6502 - protein, 229 aa, Artificial Sequence
  Description of Artificial Sequence: Synthetic single chain variable fragment sequence
EVQLVESGGGLVQPGRSLRLSCTASGFTFGDYAMSWVRQAPGKGLEWVSSISGSGRSTDHADYVKGRFTISRDNSKNTVYLQMNRLRAEDTAVYYCAKVSNYEYYFDYWAQGTLVTVSSQPVLTQPHSVSESPGKTVTISCTRSSGSIASNYVQWYQQRPGSAPTTVIYEDNQRPSGVPDRFSGSIDSSSNSASLTISGLKTEDEADYYCQSYDSSNHVFGTGTKLTVL

SEQ ID NO: 6503 - protein, 229 aa, Artificial Sequence
  Description of Artificial Sequence: Synthetic single chain variable fragment sequence
QVTLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSPPAQFGEGTKLEIK

SEQ ID NO: 6504 - protein, 229 aa, Artificial Sequence
  Description of Artificial Sequence: Synthetic single chain variable fragment sequence
QVTLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSRPLSFGEGTKLEIK

SEQ ID NO: 6505 - protein, 229 aa, Artificial Sequence
  Description of Artificial Sequence: Synthetic single chain variable fragment sequence
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSPPAQFGEGTKLEIK

SEQ ID NO: 6506 - protein, 229 aa, Artificial Sequence
  Description of Artificial Sequence: Synthetic single chain variable fragment sequence
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSNIQMTQSPSSLSASVGDRVTITCRASQSINKWLAWYQQKPGKAPKLLIHDASTLESGVPSRFSGSGSGTEFTLTISSLHPDDSATYYCQQLKSRPLSFGEGTKLEIK

SEQ ID NO: 6507 - protein, 232 aa, Artificial Sequence
  Description of Artificial Sequence: Synthetic single chain variable fragment sequence
QVTLKESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPSSVSGTPGQRVTISCSGSSSNIGSNYVYWYQQLPGTAPKLLIYRNNQRPSGVPDRFSGSKSGTSASLGHQWAPGPRMRLIITAAWDDSLSGVVFGGGTKLTVL

SEQ ID NO: 6508 - protein, 232 aa, Artificial Sequence
  Description of Artificial Sequence: Synthetic single chain variable fragment sequence
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCARDFGRWSYYFDYWSQGTLVTVSSQSVLTQPSSVSGTPGQRVTISCSGSSSNIGSNYVYWYQQLPGTAPKLLIYRNNQRPSGVPDRFSGSKSGTSASLGHQWAPGPRMRLIITAAWDDSLSGVVFGGGTKLTVL

SEQ ID NO: 6509 - protein, 227 aa, Artificial Sequence
  Description of Artificial Sequence: Synthetic single chain variable fragment sequence
EVQLVESGGGLVQPGRSLRLSCTASGFTFGDYAMSWVRQAPGKGLEWVSSISGSGRSTDHADYVKGRFTISRDNSKNTVYLQMNRLRAEDTAVYYCAKVSNYEYYFDYWAQGTLVTVSSQSVLTQPPSVSVAPGQTARITCGGNNIGSTSVHWFQQKPGQAPVLVVYDDSDRPSGIPERFSGSNSGNTATLTISRVEAGDEADYYCQVWDNDSDHRVFGGGTKLTVL

SEQ ID NO: 6510 - protein, 229 aa, Artificial Sequence
  Description of Artificial Sequence: Synthetic single chain variable fragment sequence
EVQLVESGGGLVQPGRSLRLSCTASGFTFGDYAMSWVRQAPGKGLEWVSSISGSGRSTDHADYVKGRFTISRDNSKNTVYLQMNRLRAEDTAVYYCAKVSNYEYYFDYWAQGTLVTVSSQSVLTQPPSVPGTPGQRVTITCSGSRFNIGSNTVNWYQQLPGTAPKLLIYSNNQRPSGVPDRFSGSKSGTSASLAISGLQSEDEADYYCAAWDDSLNGYVFGTGTKLTVL

SEQ ID NO: 6511 - protein, 234 aa, Artificial Sequence
  Description of Artificial Sequence: Synthetic single chain variable fragment sequence
  MOD_RES (194)..(194): Any amino acid
QVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVREAHLSYFDYWGQGTLVTVSSQSVLTQPPSVSVAPGQTARITCGGNRIGTKAVHWYQQKSGQAPVLVVRDDTDRPSGSLRDSLAPTLGTXAAATLTISGVEAGDEADYYQVWDSSSDHRVFGGGTKLTVL

SEQ ID NO: 6512 - protein, 234 aa, Artificial Sequence
  Description of Artificial Sequence: Synthetic single chain variable fragment sequence
  MOD_RES (194)..(194): Any amino acid
EVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCAKDFEVREAHLSYFDYWGQGTLVTVSSQSVLTQPPSVSVAPGQTARITCGGNRIGTKAVHWYQQKSGQAPVLVVRDDTDRPSGSLRDSLAPTLGTXAAATLTISGVEAGDEADYYQVWDSSSDHRVFGGGTKLTVL

SEQ ID NO: 6513 - protein, 247 aa, Artificial Sequence
  Description of Artificial Sequence: Synthetic single chain variable fragment sequence
QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVT

SEQ ID NO: 6514 - protein, 269 aa, Artificial Sequence
  Description of Artificial Sequence: Synthetic single chain variable fragment sequence
EFGSATMGWSCIILFLVATATGVHSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGSTSGSGKPGSGEGSTKGEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 6515 - protein, 244 aa, Artificial Sequence
  Description of Artificial Sequence: Synthetic single chain variable fragment sequence
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGSTSGSGKPGSGEGSTKGEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 6516 - protein, 265 aa, Artificial Sequence; identical to SEQ ID NO: 6492
  Description of Artificial Sequence: Synthetic single chain variable fragment sequence

SEQ ID NO: 6517 - protein, 255 aa, Artificial Sequence
  Description of Artificial Sequence: Synthetic single chain variable fragment sequence
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGSTSGSGKPGSGEGSTKGQVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYSLDYWGQGTPVTVSSGGGGSGGGGSC

SEQ ID NO: 6518 - protein, 255 aa, Artificial Sequence; identical to SEQ ID NO: 6517
  Description of Artificial Sequence: Synthetic single chain variable fragment sequence

SEQ ID NO: 6519 - protein, 246 aa, Artificial Sequence
  Description of Artificial Sequence: Synthetic single chain variable fragment sequence
EVQLVETGGGLVQPGKSLELTCATSGFTFNTAWMHWVRQSPDKRLEWIARIKDTSNNYATDYVESMKGRFTISRDDSKGSVNLQMNSLKEEDTATYYCTTDFYDGTYYWNYWGQGVMVTVSSGGGGSGGGGSGGGGSSYELIQPPSAAVTLGNTVSLTCVGDELPKRYAYWYQQKPDQSIVRVIYEDSVRPPGISDRFSGSSSGTTATLTIRDAQNEDEADYYCQSTYGDDKLYIFGGGTKLTVLG

SEQ ID NO: 6520 - protein, 257 aa, Artificial Sequence
  Description of Artificial Sequence: Synthetic single chain variable fragment sequence
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRGSTSGSGKPGSGEGSTKGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSC

SEQ ID NO: 6521 - protein, 257 aa, Artificial Sequence; identical to SEQ ID NO: 6520
  Description of Artificial Sequence: Synthetic single chain variable fragment sequence

SEQ ID NO: 6522 - protein, 247 aa, Artificial Sequence
  Description of Artificial Sequence: Synthetic single chain variable fragment sequence
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSGGGGSGGGGSGGGASDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRTAAA

SEQ ID NO: 6523 - protein, 246 aa, Artificial Sequence
  Description of Artificial Sequence: Synthetic single chain variable fragment sequence
EVQLLESGGGVVQPGRSLRLSCAASGFTFSSYAMHWVRQAPGKGLEWVAVISYDGSNKYYADSVKGRFTISRDNSKNTLYLQMNSLRAEDTAVYYCAKGGDTYGFLDNWGQGTMVTVSSGGGGSGGGGSGGGASDIQMTQSPSTLSASVGDRVTITCRASQSISSWLAWYQQKPGKAPKLLIYKASSLESGVPSRFSGSGSGTDFTLTISSLQPEDFATYYCQQFNAYPLTFGGGTKVEIKRTAAA

SEQ ID NO: 6524 - protein, 246 aa, Artificial Sequence
  Description of Artificial Sequence: Synthetic single chain variable fragment sequence
QVQLVESGGGLVQPGRSLRLSCAASGFTFSSYAMHWVRQAPGKGLEWVAVISYDGSSKYYADSVKGRFTISRDNSKNTLYLQMNSLRAEDTAVYYCAKGGGSFGAFDIWGQGTLVTVSSGGGGSGGGGSGGGASDIQMTQSPSSLSASVGDRVTITCRASQSISRYLNWYQQKPGKAPNLLIYAASSLQSGVPSRFSGSGSGTDFTLTISSLQPEDFATYYCQQYNSYPLTFGGGTKLEIKRTAAA

SEQ ID NO: 6525 - protein, 246 aa, Artificial Sequence
  Description of Artificial Sequence: Synthetic single chain variable fragment sequence
EVQLLESGGGAVQPGRSLRLSCAASGFTFSSYAMHWVRQAPGKGLEWVAVISYDGSNKYYADSVKGRFTISRDNSKNTLYLQMNSLRAEDTAVYYCASGYSSSWYLDYWGQGTLVTVSSGGGGSGGGGSGGGASDIQMTQSPSSVSASVGDRVTITCQASQDISNYLNWYQQKPGKAPKLLIYDASNLETGVPSRFSGSGSGTDFTFTISSLQPEDIATYYCQQYDNLPLTFGGGTKVEIKRTAAA

SEQ ID NO: 6526 - protein, 245 aa, Artificial Sequence
  Description of Artificial Sequence: Synthetic single chain variable fragment sequence
QVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASGGAGWNWGQGTMVTVSSGGGGSGGGGSGGGASNFMLTQPHSVSESPGKTATISCTRSSGSIASNYVQWYQQRPGSAPTTVIYEDNQRPFGVPDRFSGSIDSSSNSASLTISGLKTEDEADYYCQSHDSSNVVFGGGTQLTVLGQPAA

SEQ ID NO: 6527 - protein, 247 aa, Artificial Sequence
  Description of Artificial Sequence: Synthetic single chain variable fragment sequence
  MOD_RES (101)..(101): Any amino acid
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGYXASSWSQGLWGQGTLVTVSSGGGGSGGGGSGGGASDIQMTQSPSSLSASVRDRVTITCQASQDISNYLNWYQQKPGKAPKLLIYDASNLETGVPSRFSGSGSGTDFTFTISSLQPEDIATYYCQQYDNLPPTFGGGTKVEIKRTAAA

SEQ ID NO: 6528 - protein, 251 aa, Artificial Sequence
  Description of Artificial Sequence: Synthetic single chain variable fragment sequence
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGGSGGAFDIWGQGTLVTVSSGGGGSGGGGSGGGASDIVMTQTPHSLSVTPGQPASISCKSSQSLLYSDGKTYLYWYLQKPGQPPQLLIYEVSNRFSGVPDRFSGSGSGTDFTLKISRVEAEDVGVYYCMQSIQLYTFGQGTKVDIKRTAAA

SEQ ID NO: 6529 - protein, 244 aa, Artificial Sequence
  Description of Artificial Sequence: Synthetic single chain variable fragment sequence
QVQLVESGGGVVQPGRSLRLSCAAPGFTFSSYGMHWVRQAPGKGLEWVAVISYDGSNKYYADSVKGRFTISRDNSKNTLYLQMNSLRAEDTAVYYCARNKQYGMDVWGQGTLVTVSSGGGGSGGGGSGGGASDIVMTQSPATLSLAPGERATLSCRASQSVGSNLAWYQQKPGQAPSLLIYDASTRATGIPARFSGSGSGTDFTLTISSLQSEDIAVYYCQQYHRWPLTFGGGTKVEIKRTAAA

SEQ ID NO: 6530 - protein, 249 aa, Artificial Sequence
  Description of Artificial Sequence: Synthetic single chain variable fragment sequence
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDDGAMRYWGQGTMVTVSSGGGGSGGGGSGGGASDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYDSPYTFGQGTKVDIKRTAAA

SEQ ID NO: 6531 - protein, 244 aa, Artificial Sequence
  Description of Artificial Sequence: Synthetic single chain variable fragment sequence
QVQLVESGGGVVQPGRPLRLSCAASGFTFSSYAMHWVRQAPGKGLEWVAVISYDGSNKYYADSVKGRFTISRDNSKNTLYLQMNSLRAEDTAVYYCARAGYSYADYWGQGTMVTVSSGGGGSGGGGSGGGASDIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVDIKRTAAA

SEQ ID NO: 6532 - protein, 252 aa, Artificial Sequence
  Description of Artificial Sequence: Synthetic single chain variable fragment sequence
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSGGGGSGGGGSGGGGSDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKR

SEQ ID NO: 6533 - protein, 249 aa, Artificial Sequence
  Description of Artificial Sequence: Synthetic single chain variable fragment sequence
EVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSGGGGSGGGGSGGGASNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQPAA

SEQ ID NO: 6534 - protein, 246 aa, Artificial Sequence
  Description of Artificial Sequence: Synthetic single chain variable fragment sequence
QVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSGGGGSGGGGSGGGASSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQPAA

SEQ ID NO: 6535 - protein, 249 aa, Artificial Sequence
  Description of Artificial Sequence: Synthetic single chain variable fragment sequence
QVQLVESGGGLVKPGGSLRLSCAASGFTFSDYYMSWIRQAPGKGLEWVSYISSSGSTIYYADSVEGRFTISRDNAKNSLYLQMNSLRTEDTAVYYCARARVGGMDVWGQGTMVTVSSGGGGSGGGGSGGGASNFMLTQPHSVSESPGKTVTISCTRSSGSIASNYVQWYQQRPGSSPTTVIYEDNQRPSGVPDRFSGSIDSSSNSASLTISGLKTEDEADYYCQSFDADNLHVVFGGGTKLTVLGQPAA

SEQ ID NO: 6536 - protein, 248 aa, Artificial Sequence
  Description of Artificial Sequence: Synthetic single chain variable fragment sequence
EVQLVQSGAEVKKPGASVKVSCKASGYTFTGYYMHWVRQAPGQGLEWMGWINPNSGGTNYAQKFQGRVTMTRDTSISTAYMELSSLRSEDTAVYYCARDTGPIDYWGQGTMVTVSSGGGGSGGGGSGGGASDIVMTQTPLSLSVTPGQPASISCKSSQSLLHSDGKTYLYWYLQKPGQPPQLLVYEVSNRFSGVPDKFSGSGSGTDFTLKISRVEAEDVGVYYCMQGIQLPPTFGGGTKVDIKRTAAA

SEQ ID NO: 6537 - protein, 249 aa, Artificial Sequence
  Description of Artificial Sequence: Synthetic single chain variable fragment sequence
EVQLVQSGAEVKKPGSSVKVSCKASGGTFSSYAISWVRQAPGQGLEWMGIINPSGGSTSYAQKFQGRVTMTRDTSTSIVYMELSSLRSEDTAVYYCARGVWNSGSYLGFDYWGQGTLVTVSSGGGGSGGGGSGGGASDIQMTQSPSSLSASVGDRVTITCQASQDISNYLNWYQQKPGKAPKLLIYAASSLQSGVPSRFSGSGSGTDFTLTISSLQPEDFATYYCQQSYSTPLTFGGGTKLEIKRTAAA

SEQ ID NO: 6538 - protein, 251 aa, Artificial Sequence
  Description of Artificial Sequence: Synthetic single chain variable fragment sequence
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGFTVPGGAFDIWGQGTLVTVSSGGGGSGGGGSGGGASNFMLTQPHSVSDSPGKTVTISCTRSSGRIGSNFVQWYQQRPGSSPTTVIYEDDQRPSGVPARFSGSIDSSSNSASLTISGLTTADEAGYYCQSYDASNVIFGGGTKLTVLGQPAA

SEQ ID NO: 6539 - protein, 247 aa, Artificial Sequence
  Description of Artificial Sequence: Synthetic single chain variable fragment sequence
EVQLVESGAEVKKPGASVKVSCKASGYTFTGYYMHWVRQAPGQGLEWMGRINPNSGGTNYAQKFQGRVTMTRDTSISTAYMELSSLRSEDTAVYYCARFGERYAFDIWGQGTLVTVSSGGGGSGGGGSGGGASQSELTQPPSASGSPGQSVTISCTGTSTDVGAFHFVSWYQHTPGKAPKLLISEVRKRASGVPDRFSGSRSGNTASLTVSGLQSEDEADYFCSAYTGSNYVFGSGTKLTVLGQPAA

SEQ ID NO: 6540 - protein, 252 aa, Artificial Sequence
  Description of Artificial Sequence: Synthetic single chain variable fragment sequence
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDQWLANYYYYGMDVWGQGTLVTVSSGGGGSGGGGSGGGASSYELTQPLSVSVALGQTARITCGGNNIGSKNVHWYQQKPGQAPVLVIYRDNNRPSGIPERFSGSNSGNTATLTISKAQAGDEADYYCQVWDSNSWVFGGGTKLTVLGQPAA

SEQ ID NO: 6541 - protein, 252 aa, Artificial Sequence
  Description of Artificial Sequence: Synthetic single chain variable fragment sequence
QMQLVQSGAEVKKPGASVKVSCKASGYTFASYYMHWVRQAPGQGLEWMGIINPSGGSTSYAQKFQGRVTMTRDTSTSTVYMELSRLRSDDTAVYYCASNRGGSYKSVGMDVWGQGTTVTVSSGGGGSGGGGSGGGASNFMLTQPQSVSESPGKTVTISCTRSSGNFASKYVQWYQQRPGSSPTTVIYENYQRPSGVPDRFSGSIDSSSNSATLTISGLKTEDEADYYCQSYDEVSVVFGGGTQLTVLGQPAA

SEQ ID NO: 6542 - protein, 249 aa, Artificial Sequence
  Description of Artificial Sequence: Synthetic single chain variable fragment sequence
EVQLVQSGAEVKKPGSSVKVSCEASGYTFTSYAISWVRQAPGQGLEWMGWMNPNSGNTGYAQKFQGRVTMTRNTSISTAYMELSSLRSEDTAVYYCARVSSYYGMDVWGQGTLVTVSSGGGGSGGGGSGGGASNFMLTQPLSVSESPGKTVTISCTRSSGSIASNYVQWYQQRPGSAPTTVIYEDNQRPSGVPDRFSGSIDSSSNSASLTISGLKTEDEADYYCQSYNSSNHWVFGGGTKVTVLGQPAA

SEQ ID NO: 6543 - protein, 243 aa, Artificial Sequence
  Description of Artificial Sequence: Synthetic single chain variable fragment sequence
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIK

SEQ ID NO: 6544 - protein, 245 aa, Artificial Sequence
  Description of Artificial Sequence: Synthetic single chain variable fragment sequence
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIK

SEQ ID NO: 6545 - protein, 240 aa, Artificial Sequence
  Description of Artificial Sequence: Synthetic single chain variable fragment sequence
QVTLESGPGILPSQTLSLTCSFSGFSLSTSGMGVGWIRQPSGKGLEWLAHIWWDDDKYYNPSLKSQLTISDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIK

SEQ ID NO: 6546 - protein, 242 aa, Artificial Sequence
  Description of Artificial Sequence: Synthetic single chain variable fragment sequence
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQPDGTVLLIYYTSRLHSGVPSFSGSGSGTDYSLTISNLEQEDIATYFCQQGYTLPWTFGGGTKLEIK

SEQ ID NO: 6547 - protein, 253 aa, Artificial Sequence
  Description of Artificial Sequence: Synthetic single chain variable fragment sequence
EVQLLESGGGLVQPGGSLRLSCAASGFTFSGYAMSWVRQAPGKGLEWVSSIYSSSGSKYYADSVKGRFTISRDNSKNTLYLQMNSLRAEDTAVYYCARASSTCTRTWCSYDDAMDVWGQGTLVTVSSGGGGSGGGGSGGGGSQSVLTQPPSASGTPGQRVTISCTGSSSNIGNNAVTWYQQLPGTAPKLLIYDDSHRPSGVPDRFSGSKSGTSASLAISGLRSEDEADYYCGTWDYSLSGYVFGGGTKLTVLG

SEQ ID NO: 6548 - protein, 247 aa, Artificial Sequence
  Description of Artificial Sequence: Synthetic single chain variable fragment sequence
EVQLLESGGGLVQTGGSLRLSCAASGFTFSDYAMSWVRQAPGKGLEWVSSIYPGSGSKYYADSVKGRFAISRDNSKNTLYLQMNSLRAEDTAVYYCARDAWFRGHNVFDYWGQGTLVTVSSGGGGSGGGGSGGGGSQSVLTQPPSASGTPGQRVTISCTGSSSNIGSNNVTWYQQLPGTAPKLLIYSDSHRPSGVPDRFSGSKSGTSASLAISGLQSEDEADYYCGSWDYSLSAYVFGGGTKLTVLG

SEQ ID NO: 6549 - protein, 253 aa, Artificial Sequence
  Description of Artificial Sequence: Synthetic single chain variable fragment sequence
EVQLLESGGGLVQPGGSLRLSCAASGFTFSNYDMSWVRQAPGKGLEWVSGIYPNGGSKYYADSVKGRFTISRDNSKNTLYLQMNSLRAEDTAVYYCARALRQCQRYWCSYADGMDVWGQGTLVTVSSGGGGSGGGGSGGGGSQSVLTQPPSASGTPGQRVTISCTGSSSNIGSNYVSWYQQLPGTAPKLLIYADSQRPSGVPDRFSGSKSGTSASLAISGLRSEDEADYYCGTWDYSLSGYVLGGGTKLTVLG

SEQ ID NO: 6550 - protein, 247 aa, Artificial Sequence
  Description of Artificial Sequence: Synthetic single chain variable fragment sequence
EVQLLESGGGLVQPGGSLRLSCAASGFTFSDYYMSWVRQAPGKGLEWVSAIYSGGGSIYYADSVKGRFTISRDNSKNTLYLQMNSLRAEDTAVYYCARDVQWNKAPRFDYWGQGTLVTVSSGGGGSGGGGSGGGGSQSVLTQPPSASGAPGQRVTISCSGSSSNIGSNDVSWYQQLPGTAPKLLIYADSNRPSGVPDRFSGSKSGTSASLAISGLRSEDEADYYCGSWDYSLSGYVFGGGTKLTVLG

SEQ ID NO: 6551 - protein, 247 aa, Artificial Sequence
  Description of Artificial Sequence: Synthetic single chain variable fragment sequence
EVQLLESGGGLVQPGGSLRLSCAASGFTFSSYSMSWVRQAPGKGLEWVSGISHGGGNKYYADSVKGRFTISRDNSKNTLYLQMNSLRAEDTAVYYCARDLRANNDTGFDYWGQGTLVTVSSGGGGSGGGGSGGGGTQSVLTQPPSSSGTPGQRVTISCTGSSSNIGSNAVTWYQQLPGTAPKLLIYDDNHRPSGVPDRFSGSKSGTSASLAISGLRSEDEADYYCGAWDYSLNAYVFGGGTKLTVLG

SEQ ID NO: 6552 - protein, 253 aa, Artificial Sequence
  Description of Artificial Sequence: Synthetic single chain variable fragment sequence
EVQLLESGGGLVQPGGSLRLSCAASGFTFSNYDMSWVRQAPGKGLEWVSLISHGGGNIYYADSVKGRFTISRDNSKNTLYLQMNSLRAEDTAVYYCARVPVMCTNHWCSYANGMDVWGQGTLVTVSSGGGGSGGGGSGGGGSQSVLTQPPSASGTPGQRVIISCSASSSNIGSNAVYWYQQLPGTAPKLLIYSDNQRPSGVPDRFSGSKSGTSASLAISGLRSEDEADYYCGSWDYSLSAYVFGGGTKLTVLG

SEQ ID NO: 6553 - protein, 247 aa, Artificial Sequence
  Description of Artificial Sequence: Synthetic single chain variable fragment sequence
EVQLLESGGGLVQPGGSLRLSCAASGFTFSGYAMSWVRQAPGKGLEWVSGISHDGGNTYYADSVKGRFTISRDNSKNTLYLQMNSLRAEDTAVYYCARDRRKGPSTEFDYWGQGTLVTVSSGGGGSGGGGSGGGGSQSVLTQPPSLSGTPGQRVTISCTGSSSNIGSNSVSWYQQLPGTAPKLLIYDDNNRPSGVPDRFSGSKSGTSASLAISGLRSEDEADYYCGAWDYSLSAYVFGGGTKLTVLG

SEQ ID NO: 6554 - protein, 253 aa, Artificial Sequence
  Description of Artificial Sequence: Synthetic single chain variable fragment sequence
EVQLLESGGGLVQTGGSLRLSCAASGFTFSDYAMSWVRQAPGKGLEWVSWIYPGDSSIYYADSVKGRFTISRDNSKNTLYLQMNSLRAEDTAVYYCARLLSIDQAQLHYYYDAMDVWGQGTLVTVSSGGGGSGGGGSGGGGSQSVLTQPPSPSGTPGQRVTISCTGSSSNIGNYYVYWYQQLPGTAPKLLIYANSHRPSGVPDRFSGSKSGTSASLAISGLRSEDEADYYCGSWDDSLSAYVFGGGTKLTVLG

SEQ ID NO: 6555 - protein, 255 aa, Artificial Sequence
  Description of Artificial Sequence: Synthetic single chain variable fragment sequence
EVQLLESGGGLVQPGGSLRLSCAASGFTFSWYDMDWVRQAPGKGLEWVSVISPSGGWTAYADSVKGRFTISRDNSKNTLYLQMNSLRAEDTAVYYCARDSSGYYSPDAFDIWGQGTLVTVSSVGSGGSGGGGSGGGGSGGGGSGGSGGNIQMTQSPSSLSASVGDRVTITCRASQSISSYLNWYQQKPGKAPKLLIYDASSLQSGVPLRFSGSGSGTDFTLTISSLQPEDFATYYCQQSYSTPLTFGGGTKVDIK

SEQ ID NO: 6556 - protein, 248 aa, Artificial Sequence
  Description of Artificial Sequence: Synthetic single chain variable fragment sequence
EVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSVGSGGSGGGGSGGGGSGGGGSGGSGGQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTV

SEQ ID NO: 6557 - protein, 254 aa, Artificial Sequence
  Description of Artificial Sequence: Synthetic single chain variable fragment sequence
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTLVTVSSVGSGGSGGGGSGGGGSGGGGSGGSGGDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 6558 - protein, 254 aa, Artificial Sequence
  Description of Artificial Sequence: Synthetic single chain variable fragment sequence
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSVGSGGSGGGGSGGGGSGGGGSGGSGGNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 6559 - protein, 251 aa, Artificial Sequence
  Description of Artificial Sequence: Synthetic single chain variable fragment sequence
AIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKLGSGGSGGGGSGGGGSGGGGSGGSGGEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 6560 - protein, 252 aa, Artificial Sequence
  Description of Artificial Sequence: Synthetic single chain variable fragment sequence
EVQLLESGGGLVQPGGSLRLSCAASGFTFSTYDMHWVRQAPGKGLEWVSVISPSGGWTAYADSVKGRFTISRDNSKNTLYLQMNSLRAEDTAVYYCARAAAGYDAFDIWGQGTMVTVSSVGSGGSGGGGSGGGGSGGGGSGGSGGEIVLTQSPSPLSASVGDRVTITCRASHNINKYLNWYQQKPGKAPKLLIFGASSLRSGVPSRFSGSGSGTDFTLTISSLEPEDLATYFCQQTYNTPLTFGGGTKLEIK

SEQ ID NO: 6561 - protein, 260 aa, Artificial Sequence
  Description of Artificial Sequence: Synthetic single chain variable fragment sequence
MDFQVQIFSFLLISASVIMSRGDIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGSTSGSGKPGSGEGSEVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSS

SEQ ID NO: 6562 - protein, 265 aa, Artificial Sequence
  Description of Artificial Sequence: Synthetic single chain variable fragment sequence
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELK

SEQ ID NO: 6563 - protein, 251 aa, Artificial Sequence
  Description of Artificial Sequence: Synthetic single chain variable fragment sequence
QSVLTQPPSVSGAPGQRVTISCTGSSSNIGAGYDVHWYQQLPGTAPKLLIYGNSNRPSGVPDRFSGSKSGTSASLAISGLQSEDEADYYCAAWDDSLNGYVFGTGTKLTVLGSRGGGGSGGGGSGGGGSLEMAEVQLVETGGGLLQPGGSLRLSCAASGFSVSGTYMGWVRQAPGKGLEWVALLYSGGGTYHPASLQGRFIVSRDSSKNMVYLQMNSLKAEDTAVYYCAKGGAGGGHFDSWGQGTLVTVSS

SEQ ID NO: 6564 - protein, 243 aa, Artificial Sequence
  Description of Artificial Sequence: Synthetic single chain variable fragment sequence
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 6565 - protein, 250 aa, Artificial Sequence
  Description of Artificial Sequence: Synthetic single chain variable fragment sequence
QTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGSRGGGGSGGGGSGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSS

SEQ ID NO: 6566 - protein, 250 aa, Artificial Sequence
  Description of Artificial Sequence: Synthetic single chain variable fragment sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIKRSRGGGGSGGGGSGGGGSLEMAQVQLQQSGPGLVKPSQTLSLTCAISGDSVSSNSAAWNWIRQSPSRGLEWLGRTYYGSKWYNDYAVSVKSRITINPDTSKNQFSLQLNSVTPEDTAVYYCARGRLGDAFDIWGQGTMVTVSS

SEQ ID NO: 6567 - protein, 253 aa, Artificial Sequence
  Description of Artificial Sequence: Synthetic single chain variable fragment sequence
QAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGSRGGGGSGGGGSGGGGSLEMAQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSS

SEQ ID NO: 6568 - protein, 246 aa, Artificial Sequence
  Description of Artificial Sequence: Synthetic single chain variable fragment sequence
DIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRSRGGGGSGGGGSGGGGSLEMAQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSS

SEQ ID NO: 6569 - protein, 249 aa, Artificial Sequence
  Description of Artificial Sequence: Synthetic single chain variable fragment sequence
QSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGSRGGGGSGGGGSGGSLEMAEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSS

SEQ ID NO: 6570 - protein, 258 aa, Artificial Sequence
  Description of Artificial Sequence: Synthetic single chain variable fragment sequence
SRAAQPAMAQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSETGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKRAA

SEQ ID NO: 6571 - protein, 243 aa, Artificial Sequence
  Description of Artificial Sequence: Synthetic single chain variable fragment sequence
QLVESGGGLVQPGRSLRLSCTTSGFTFGDYAMIWARQAPGKGLEWVSSISSSSSYIYYADSVKGRFTISRDNAKNSLYLQMNSLRAEDTAVYYCARERYDFWSGMDVWGKGTTVTVSSGGGGSGGGGSGGSAQSALTQPASVSGSPGQSITISCTGTSSDVGSYNLVSWYQQHPGKAPKLMIYEGSKRPSGVSNRFSGSKSGNAASLTISGLQAEDEADYYCQSYDSSLSVVFGGGTKLTVLG

SEQ ID NO: 6572 - protein, 120 aa, Homo sapiens
WRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 6573 - protein, 49 aa, Homo sapiens
HQRRKYRSNKGESPVEPAEPCRYSCPREEEGSTIPIQEDYRKPEPACSP

SEQ ID NO: 6574 - protein, 111 aa, Homo sapiens
RRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 6575 - protein, 114 aa, Homo sapiens
CCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 6576 - protein, 27 aa, Homo sapiens
FWVLVVVGGVLACYSLLVTVAFIIFWV

SEQ ID NO: 6577 - protein, 42 aa, Homo sapiens
KRGRKKLLYIFKQPFMRPVQTTQEEDGCSCRFPEEEEGGCEL

SEQ ID NO: 6578 - protein, 44 aa, Homo sapiens
FWVRSKRSRLLHSDYMNMTPRRPGPTRKHYQPYAPPRDFAAYRS

SEQ ID NO: 6579 - protein, 41 aa, Homo sapiens
RSKRSRGGHSDYMNMTPRRPGPTRKHYQPYAPPRDFAAYRS

SEQ ID NO: 6580 - protein, 43 aa, Homo sapiens
RSKRSRGGHSDYIVINMTPRRPGPTRKHYQPYAPPRDFAAYRS

SEQ ID NO: 6581 - protein, 220 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 6582 - protein, 187 aa, Homo sapiens
RRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 6583 - protein, 187 aa, Homo sapiens; identical to SEQ ID NO: 6582

SEQ ID NO: 6584 - protein, 54 aa, Homo sapiens
HIWQLRSQCMWPRETQLLLEVPPSTEDARSCQFPEEERGERSAEEKGRLGDLWV

SEQ ID NO: 6585 - protein, 60 aa, Homo sapiens
CVKRRKPRGDVVKVIVSVQRKRQEAEGEATVIEALQAPPDVTTVAVEETIPSFTGRSPNH

SEQ ID NO: 6586 - protein, 35 aa, Homo sapiens
TKKKYSSSVHDPNGEYMFMRAVNTAKKSRLTDVTL

SEQ ID NO: 6587 - protein, 38 aa, Homo sapiens
CWLTKKKYSSSVHDPNGEYMFMRAVNTAKKSRLTDVTL

SEQ ID NO: 6588 - protein, 54 aa, Homo sapiens
HLWRRQWRPRRFSALEQGIHPPQAQSKIEELEQEPEPEPEPEPEPEPEPEPEQL

SEQ ID NO: 6589 - protein, 42 aa, Homo sapiens
ALYLLRRDQRLPPDAHKPPGGGSFRTPIQEEQADAHSTLAKI

SEQ ID NO: 6590 - protein, 37 aa, Homo sapiens
RRDQRLPPDAHKPPGGGSFRTPIQEEQADAHSTLAKI

SEQ ID NO: 6591 - protein, 42 aa, Homo sapiens
KRGRKKLLYIFKQPFMRPVQTIQEEDGCSCRFPEEEEGGCEL

SEQ ID NO: 6592 - protein, 42 aa, Homo sapiens
KRGRKKLLYIFKQPFMRPVQTTQEEDGCSCRFPEEEEGGYEL

SEQ ID NO: 6593 - protein, 225 aa, Homo sapiens
TGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6594 - protein, 154 aa, Homo sapiens
KRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6595 - protein, 194 aa, Homo sapiens
KRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 6596 - protein, 47 aa, Homo sapiens
RFSVVKRGRKKLLYIFKQPFMRPVQTTQEEDGCSCRFPEEEEGGCEL

SEQ ID NO: 6597 - protein, 341 aa, Homo sapiens
RKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 6598 - protein, 48 aa, Homo sapiens
QRRKYRSNKGESPVEPAEPCHYSCPREEEGSTIPIQEDYRKPEPACSP

SEQ ID NO: 6599 - protein, 6 aa, Homo sapiens
FAAYRS

SEQ ID NO: 6600 - protein, 68 aa, Homo sapiens; identical to SEQ ID NO: 5966

SEQ ID NO: 6601 - protein, 41 aa, Homo sapiens
RSKRSRLLHSDYMNMTPRRPGPTRKHYQPYAPPRDFAAYRS

SEQ ID NO: 6602 - protein, 40 aa, Homo sapiens
SKRSRLLHSDYMNMTPRRPGPTRKHYQPYAPPRDFAAYRS

SEQ ID NO: 6603 - protein, 106 aa, Homo sapiens
IEVMYPPPYLDNEKSNGTIIHVKGKHLCPSPLFPGPSKPFWVLVVVGGVLACYSLLVTVAFIIFWRSKRSRLLHSDYMNMTPRRPGPTRKHYQPYAPPRDFAAYRS

SEQ ID NO: 6604 - protein, 200 aa, Homo sapiens
RSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6605 - protein, 222 aa, Homo sapiens
AAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6606 - protein, 188 aa, Homo sapiens
RSKRSRLLHSDYNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6607 - protein, 70 aa, Homo sapiens
MFWVLVVVGGVLACYSLLVTVAFIIFWVKRGRKKLLYIFKQPFMRPVQTTQEEDGCSCRFPEEEEGGCEL

SEQ ID NO: 6608 - protein, 108 aa, Homo sapiens
IEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCEL

SEQ ID NO: 6609 - protein, 153 aa, Homo sapiens
RSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6610 - protein, 151 aa, Homo sapiens
KRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6611 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 6612 - protein, 127 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 6613 - protein, 21 aa, Homo sapiens
DQVYQPLRDRDDAQYSHLGGN

SEQ ID NO: 6614 - protein, 171 aa, Homo sapiens; identical to SEQ ID NO: 6611

SEQ ID NO: 6615 - protein, 127 aa, Homo sapiens; identical to SEQ ID NO: 6612

SEQ ID NO: 6616 - protein, 21 aa, Homo sapiens
DQVYQPLRDRDDAQYSHLGGN

SEQ ID NO: 6617 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 6618 - protein, 21 aa, Homo sapiens
NPDYEPIRKGQRDLYSGLNQR

SEQ ID NO: 6619 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 6620 - protein, 21 aa, Homo sapiens
DQLYQPLKDREDDQYSHLQGN

SEQ ID NO: 6621 - protein, 21 aa, Homo sapiens
DQLYQPLKDREDDQYSHLQGN

SEQ ID NO: 6622 - protein, 182 aa, Homo sapiens; identical to SEQ ID NO: 6619

SEQ ID NO: 6623 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6624 - protein, 164 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 6625 - protein, 164 aa, Homo sapiens; identical to SEQ ID NO: 6624

SEQ ID NO: 6626 - protein, 21 aa, Homo sapiens
NQLYNELNLGRREEYDVLDKR

SEQ ID NO: 6627 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6628 - protein, 21 aa, Homo sapiens
DGLYQGLSTATKDTYDALHMQ

SEQ ID NO: 6629 - protein, 112 aa, Homo sapiens
RVKFSRSAEPPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6630 - protein, 113 aa, Homo sapiens
RVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 6631 - protein, 114 aa, Homo sapiens
RSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6632 - protein, 98 aa, Homo sapiens
RVKFSRSADAPAYQQGEYDVLDKRRGRDPEMGGKPRRKNPQEGLYNELQKDKMAEAYSEIGMKGERRRGKGHDGLYQGLSTATKDTYDALHMQALPPR

SEQ ID NO: 6633 - protein, 112 aa, Homo sapiens
RVKFSRSADAPAYQQGQNQLYNELNLGRREEVDVLDKRRGRDPEMGGKPRRKNPQEGLYNELQKDKMAEAYSEIGMKGERRRGKGHDGLYQGLSTATKDTYDALHMQALPPR

SEQ ID NO: 6634 - protein, 173 aa, Homo sapiens
MIPAVVLLLLLLVEQAAALGEPQLCYILDAILFLVGIVLTLLVCRLKIQVRKAAITSYEKSRVKFSRSADAPAYQQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 6635 - protein, 113 aa, Homo sapiens
LRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6636 - protein, 60 aa, Homo sapiens
RVKFSRSADAPAYQQGQNQLYNELNLGRREEYDVLDKRRGRDPEMGGKPQRRKNPQEGLY

SEQ ID NO: 6637 - protein, 114 aa, Homo sapiens
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 6638 - protein, 113 aa, Homo sapiens
RRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6639 - protein, 21 aa, Homo sapiens
NQLYNELNLGRREEYDVLDKR

SEQ ID NO: 6640 - protein, 22 aa, Homo sapiens
EGLYNELQKDKMAEAYSEIGMK

SEQ ID NO: 6641 - protein, 21 aa, Homo sapiens
DGLYQGLSTATKDTYDALHMQ

SEQ ID NO: 6642 - protein, 112 aa, Homo sapiens; identical to SEQ ID NO: 6627

SEQ ID NO: 6643 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6644 - protein, 110 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALP

SEQ ID NO: 6645 - protein, 137 aa, Homo sapiens
DPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 6646 - protein, 163 aa, Homo sapiens; identical to SEQ ID NO: 6623

SEQ ID NO: 6647 - protein, 38 aa, Homo sapiens
RSRDQRLPPDAHKPPGGGSFRTPIQEEQADAHSTLAKI

SEQ ID NO: 6648 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 6649 - protein, 188 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNEPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 6650 - protein, 226 aa, Homo sapiens; identical to SEQ ID NO: 6648

SEQ ID NO: 6651 - protein, 21 aa, Homo sapiens
ENLYEGLNLDDCSMYEDISRG

SEQ ID NO: 6652 - protein, 84 aa, Homo sapiens
FVPVFLPAKPTTTPAPRPPTPAPTIASQPLSLRPEACRPAAGGAVHTRGLDFACDIYIWAPLAGTCGVLLLSLVITLYCNHRNR

SEQ ID NO: 6653 - protein, 84 aa, Homo sapiens
FVPVFLPAKPITTPAPRPPTPAPTIASQPLSLRPEACRPAAGGAVHTRGLDFACDIYIWAPLAGTCGVLLLSLVITLYCNHRNR

SEQ ID NO: 6654 - protein, 47 aa, Homo sapiens
PTTTPAPRPPTPAPTIASQPLSLRPEACRPAAGGAVHTRGLDFACDI

SEQ ID NO: 6655 - protein, 41 aa, Homo sapiens
AVSLSKMLKKRSPLTTGVFVKMAPTEAECEKQFQPYFIPIN

SEQ ID NO: 6656 - protein, 47 aa, Homo sapiens
AVSLSKMLKKRSPLTTGVYMNMTPRRPECEKQFQPYAPPRDFAAYRS

SEQ ID NO: 6657 - protein, 20 aa, Homo sapiens
RPRRSPAQDGKVYINMPGRG

SEQ ID NO: 6658 - protein, 113 aa, Homo sapiens
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 6659 - protein, 112 aa, Homo sapiens
MGGLEPCSRLLLLPLLLAVSGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 6660 - protein, 102 aa, Homo sapiens
MGGLEPCSRLLLLPLLLAVSDCSCSTVSPGVLAGIVMGDLVLTVLIALAVYFLGRLVPRGRGAAEAATRKQRITETESPYQELQGQRSDVYSDLNTQRPYYK

SEQ ID NO: 6661 - protein, 101 aa, Homo sapiens
MGGLEPCSRLLLLPLLLAVSDCSCSTVSPGVLAGIVMGDLVLTVLIALAVYFLGRLVPRGRGAAEATRKQRITETESPYQELQGQRSDVYSDLNTQRPYYK

SEQ ID NO: 6662 - protein, 113 aa, Homo sapiens; identical to SEQ ID NO: 6658

SEQ ID NO: 6663 - protein, 112 aa, Homo sapiens; identical to SEQ ID NO: 6659

SEQ ID NO: 6664 - protein, 102 aa, Homo sapiens; identical to SEQ ID NO: 6660

SEQ ID NO: 6665 - protein, 101 aa, Homo sapiens; identical to SEQ ID NO: 6661

SEQ ID NO: 6666 - protein, 21 aa, Homo sapiens
ESPYQELQGQRSDVYSDLNTQ

SEQ ID NO: 6667 - protein, 21 aa, Homo sapiens
ESPYQELQGQRSDVYSDLNTQ

SEQ ID NO: 6668 - protein, 49 aa, Homo sapiens
RSQCMWPRETQLLLEVPPSTEDARSCQFPEEERGERSAEEKGRLGDLWV

SEQ ID NO: 6669 - protein, 35 aa, Homo sapiens
TKKKYSSSVHDPNGEFMFMRAVNTAKKSRLTDVTL

SEQ ID NO: 6670 - protein, 39 aa, Homo sapiens
KSRQTPPLASVEMEAMEALPVTWGTSSRDEDLENCSHHL

SEQ ID NO: 6671 - protein, 149 aa, Homo sapiens
RRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6672 - protein, 619 aa, Homo sapiens
MPDPAAHLPFFYGSISRAEAEEHLKLAGMADGLFLLRQCLRSLGGYVLSLVHDVRFHHFPIERQLNGTYAIAGGKAHCGPAELCEFYSRDPDGLPCNLRKPCNRPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 6673 - protein, 180 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVR

SEQ ID NO: 6674 - protein, 240 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDG

SEQ ID NO: 6675 - protein, 86 aa, Homo sapiens
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 6676 - protein, 21 aa, Homo sapiens
DGVYTGLSTRNQETYETLKHE

SEQ ID NO: 6677 - protein, 66 aa, Homo sapiens
DPKLCYILDAILFLYGIVLTLLYCRLKIQVRKAAITSYEKSDGVYTGLSTRNQETYETLKHEKPPQ

SEQ ID NO: 6678 - protein, 21 aa, Homo sapiens
DGVYTGLSTRNQETYETLKHE

SEQ ID NO: 6679 - protein, 46 aa, Homo sapiens
TTTPAPRPPTPAPTIASQPLSLRPEACRPAAGGAVHTRGLDFACDI

SEQ ID NO: 6680 - protein, 31 aa, Homo sapiens
IISFFLALTSTALLFLLFFLTLRFSVVKRGR

SEQ ID NO: 6681 - protein, 27 aa, Homo sapiens
IISFFLALTSTALLFLLFFLTLRFSVV

SEQ ID NO: 6682 - protein, 26 aa, Homo sapiens
VAAILGLGLVLGLLGPLAILLALYLL

SEQ ID NO: 6683 - protein, 363 aa, Homo sapiens
AVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEVVTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 6684 - protein, 21 aa, Homo sapiens
AVFGCIFGALVIVTVGGFIFW

SEQ ID NO: 6685 - protein, 185 aa, Homo sapiens
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 6686 - protein, 106 aa, Homo sapiens
IEVMYPPPYLDNEKSNGTITHVKGKHLCPSPLFPGPSKPFWVLVVVGGVLACYSLLVTVAHIFWVRSKRSRLLHSDYMNMTPRRPGPTRKHYQPYAPPRDFAAYRS

SEQ ID NO: 6687 - protein, 27 aa, Homo sapiens
FWVLVVVGGVLACYSLLVTVAFIIFWV

SEQ ID NO: 6688 - protein, 66 aa, Homo sapiens
IEVMYPPPYLDNEKSNGTIIHVKGKHLCPSPLFPGPSKPFWVLVVVGGVLACYSLLVTVAFIIFWV

SEQ ID NO: 6689 - protein, 33 aa, Homo sapiens
IFWVLVVVGGVLACYSLLVTVAFIIFWVRSKRR

SEQ ID NO: 6690 - protein, 68 aa, Homo sapiens; identical to SEQ ID NO: 5966

SEQ ID NO: 6691 - protein, 28 aa, Homo sapiens
MFWVLVVVGGVLACYSLLVTVAFIIFWV

SEQ ID NO: 6692 - protein, 26 aa, Homo sapiens
FWVLVVVGGVLACYSLLVTVAFHFWV

SEQ ID NO: 6693 - protein, 28 aa, Homo sapiens
MFWVLVVVGGVLACYSGGVTVAFIIFWV

SEQ ID NO: 6694 - protein, 26 aa, Homo sapiens
WVLVVVGGVLACYSLLVTVAFIIFWV

SEQ ID NO: 6695 - protein, 69 aa, Homo sapiens
PFWVLVVVGGVLACYSLLVTVAFIIFWVRSKRSRLLHSDYMNMTPRRPGPTRKHYQPYAPPRDFAAYRS

SEQ ID NO: 6696 - protein, 180 aa, Homo sapiens
FWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6697 - protein, 216 aa, Homo sapiens
FWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6698 - protein, 140 aa, Homo sapiens
FWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6699 - protein, 222 aa, Homo sapiens; identical to SEQ ID NO: 6605

SEQ ID NO: 6700 - protein, 23 aa, Homo sapiens
LCYLLDGILFIYGVILTALFLRV

SEQ ID NO: 6701 - protein, 51 aa, Homo sapiens
MKWKALFTAAILQAQLPITEAQSFGLLDPKLCYLLDGILFIYGVILTALFL

SEQ ID NO: 6702 - protein, 21 aa, Homo sapiens
LCYLLDGILFIYGVILTALFL

SEQ ID NO: 6703 - protein, 25 aa, Homo sapiens
ALIVLGGVAGLLLFIGLGIFFCVRC

SEQ ID NO: 6704 - protein, 22 aa, Homo sapiens
MALIVLGGVAGLLLFIGLGIFF

SEQ ID NO: 6705 - protein, 725 aa, Homo sapiens
ALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIWHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQWKQKLPQKNSSEGNKHHKSTPLLIHCRDGSQQTGIFCALLNLLESAETEEWDIFQWKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 6706 - protein, 23 aa, Homo sapiens
PLFIPVAVMVTAFSGLAFIIWLA

SEQ ID NO: 6707 - protein, 24 aa, Homo sapiens
ALPAALAVISFLLGLGLGVACVLA

SEQ ID NO: 6708 - protein, 21 aa, Homo sapiens
MALPVTALLLPLALLLHAARP

SEQ ID NO: 6709 - protein, 286 aa, Homo sapiens
AAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6710 - protein, 226 aa, Homo sapiens
AAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6711 - protein, 83 aa, Homo sapiens
FVPVFLPAKPTTTPAPRPPTPAPTIASQPLSLRPEACRPAAGGAVHTRGLDFACDIYIWAPLAGTCGVLLLSLVITLYCNHRN

SEQ ID NO: 6712 - protein, 22 aa, Homo sapiens
IWAPLAGTCGVLLLSLVITLYC

SEQ ID NO: 6713 - protein, 24 aa, Homo sapiens
IYIWAPLAGTCGVLLLSLVITLYC

SEQ ID NO: 6714 - protein, 25 aa, Homo sapiens
IYIWAPLAGTCGVLLLSLVITLYCR

SEQ ID NO: 6715 - protein, 25 aa, Homo sapiens
IYIWAPLAGTCGVLLLSLVITLVCR

SEQ ID NO: 6716 - protein, 21 aa, Homo sapiens
IYIWAPLAGTCGVLLLSLVIT

SEQ ID NO: 6717 - protein, 23 aa, Homo sapiens
IYIWAPLAGTCGVLLLSLVITLY

SEQ ID NO: 6718 - protein, 23 aa, Homo sapiens
LGLLVAGVLVLLVSLGVAIHLCC

SEQ ID NO: 6719 - protein, 101 aa, Homo sapiens
APVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSD

SEQ ID NO: 6720 - protein, 257 aa, Homo sapiens
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 6721 - protein, 54 aa, Homo sapiens
DIFIPLLVVILFAVDTGLFISTQQQVTFLLKIKRTRKGFRLLNPHPKPNPKNNR

SEQ ID NO: 6722 - protein, 31 aa, Homo sapiens
PLGWLTVVLLAVAACVLLLTSAQLGLHIWQL

SEQ ID NO: 6723 - protein, 24 aa, Homo sapiens
SIISAVVGILLVVVLGVVFGILII

SEQ ID NO: 6724 - protein, 113 aa, Homo sapiens
CHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILI

SEQ ID NO: 6725 - protein, 21 aa, Homo sapiens
FWLPIGCAAFVVVCILGCILI

SEQ ID NO: 6726 - protein, 233 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKD

SEQ ID NO: 6727 - protein, 21 aa, Homo sapiens
VAAILGLGLVLGLLGPLAILL

SEQ ID NO: 6728 - protein, 24 aa, Homo sapiens
IYIWAPLAGTCGVLLLSLVITLYC

SEQ ID NO: 6729 - protein, 24 aa, Homo sapiens
IYIWAPLAGTCGVLLLSLVITLYC

SEQ ID NO: 6730 - protein, 5 aa, Homo sapiens
DKTHT

SEQ ID NO: 6731 - protein, 4 aa, Homo sapiens
CPPC

SEQ ID NO: 6732 - protein, 15 aa, Homo sapiens
CPEPKSCDTPPPCPR

SEQ ID NO: 6733 - protein, 12 aa, Homo sapiens
ELKTPLGDTTHT

SEQ ID NO: 6734 - protein, 10 aa, Homo sapiens
KSCDKTHTCP

SEQ ID NO: 6735 - protein, 7 aa, Homo sapiens
KCCVDCP

SEQ ID NO: 6736 - protein, 7 aa, Homo sapiens
KYGPPCP

SEQ ID NO: 6737 - protein, 16 aa, Homo sapiens
VEPKSPDKTHTCPPCP

SEQ ID NO: 6738 - protein, 16 aa, Homo sapiens
LDPKSSDKTHTCPPCP

SEQ ID NO: 6739 - protein, 39 aa, Homo sapiens
IEVMYPPPYLDNEKSNGTIIHVKGKHLCPSPLFPGPSKP

SEQ ID NO: 6740 - protein, 12 aa, Homo sapiens
GGAVHTRGLDFA

SEQ ID NO: 6741 - protein, 45 aa, Homo sapiens
TTTPAPRPPTPAPTIASQPLSLRPEACRPAAGGAVHTRGLDFACD

SEQ ID NO: 6742 - protein, 48 aa, Homo sapiens
AKPTTTPAPRPPTPAPTIASQPLSLRPEACRPAAGGAVHTRGLDFACD

SEQ ID NO: 6743 - protein, 45 aa, Homo sapiens; identical to SEQ ID NO: 6741

SEQ ID NO: 6744 - protein, 45 aa, Homo sapiens; identical to SEQ ID NO: 6741

SEQ ID NO: 6745 - protein, 79 aa, Homo sapiens
TTTPAPRPPTPAPTIASQPLSLRPEACRPAAGGAVHTRGLDFACDEPKSPDKTHTCPPCPAPPVAGPSVFLFPPKPKDT

SEQ ID NO: 6746 - protein, 51 aa, Homo sapiens
PAKPTTTPAPRPPTPAPTIASQPLSLRPEACRPAAGGAVHTRGLDFACDIY

SEQ ID NO: 6747 - protein, 69 aa, Homo sapiens
TTTPAPRPPTPAPTIASQPLSLRPEACRPAAGGAVHTRGLDFACDIYIWAPLAGTCGVLLLSLVITLYC

SEQ ID NO: 6748 - protein, 44 aa, Homo sapiens
TTPAPRPPTPAPTIASQPLSLRPEACRPAAGGAVHTRGLDFACD

SEQ ID NO: 6749 - protein, 47 aa, Homo sapiens
TTTPAPRPPTPAPTIASQPLSLRPEACRPAAGGAVHTRGLDFACDIY

SEQ ID NO: 6750 - protein, 11 aa, Homo sapiens
LDKTHTCPPCP

SEQ ID NO: 6751 - protein, 101 aa, Homo sapiens; identical to SEQ ID NO: 6719

SEQ ID NO: 6752 - protein, 16 aa, Homo sapiens
GLAVSTISSFFPPGYQ

SEQ ID NO: 6753 - protein, 16 aa, Homo sapiens
GLAVSTISSFFPPGYQ

SEQ ID NO: 6754 - protein, 282 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 6755 - protein, 246 aa, Homo sapiens
YVTVSSQDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 6756 - protein, 45 aa, Homo sapiens
KPTTTPAPRPPTPAPTIASQPLSLRPEACRPAAGGAVHTRGLDFA

SEQ ID NO: 6757 - protein, 16 aa, Homo sapiens
LEPKSCDKTHTCPPCP

SEQ ID NO: 6758 - protein, 43 aa, Homo sapiens
KPTTTPAPRPPTPAPTIASQPLSLRPEACRPAAGGAVHTRGLD

SEQ ID NO: 6759 - protein, 15 aa, Homo sapiens
EPKSCDKTHTCPPCP

SEQ ID NO: 6760 - protein, 16 aa, Homo sapiens
ELKTPLGDTHTCPRCP

SEQ ID NO: 6761 - protein, 15 aa, Homo sapiens
EPKSCDTPPPCPRCP

SEQ ID NO: 6762 - protein, 12 aa, Homo sapiens
ESKYGPPCPSCP

SEQ ID NO: 6763 - protein, 12 aa, Homo sapiens
ERKCCVECPPCP

SEQ ID NO: 6764 - protein, 229 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6765 - protein, 119 aa, Homo sapiens
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6766 - protein, 282 aa, Homo sapiens; identical to SEQ ID NO: 6754

SEQ ID NO: 6767 - protein, 281 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 6768 - protein, 283 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMVVLEDQREVNTSGFAPARPPPQPGSTTFWAWSVLRVPAPPSPQPATYTCVVSHEDSRTLLNASRSLEVSYVTDH

SEQ ID NO: 6769 - protein, 58 aa, Homo sapiens
ESPKAQASSVPTAQPQAEGSLAKATTAPATTRNTGRGGEEKKKEKEKEEQEERETKTP

SEQ ID NO: 6770 - protein, 282 aa, Homo sapiens; identical to SEQ ID NO: 6754

SEQ ID NO: 6771 - protein, 282 aa, Homo sapiens; identical to SEQ ID NO: 6754

SEQ ID NO: 6772 - protein, 281 aa, Homo sapiens
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPQPGSTTFWAWSVLRVPAPPSPQPATYTCVVSHEDSRTLLNASRSLEVSYVTDH

SEQ ID NO: 6773 - protein, 282 aa, Homo sapiens; identical to SEQ ID NO: 6754

SEQ ID NO: 6774 - protein, 234 aa, Homo sapiens
AEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKD

SEQ ID NO: 6775 - protein, 234 aa, Homo sapiens; identical to SEQ ID NO: 6774

SEQ ID NO: 6776 - protein, 20 aa, Homo sapiens
AEPKSPDKTHTCPPCPKDPK

SEQ ID NO: 6777 - protein, 15 aa, Homo sapiens
EPKSCDKTHTCPPCP

SEQ ID NO: 6778 - protein, 233 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEVKCKVSNKALPAPIEKTISKAKGQPREPQVYTLPPSRDELTKNQVSLTCLVKGFYPSDIAVEWESNGQPENNYKTTPPVLDSDGSFFLVSKLTVDKSRWQQGNVFSCSVMHEALHNHYTQKSLSLSPGKKD

SEQ ID NO: 6779 - protein, 13 aa, Homo sapiens
SVFLFPPKPKDTL

SEQ ID NO: 6780 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6781 - protein, 235 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPK

SEQ ID NO: 6782 - protein, 223 aa, Homo sapiens
VECPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6783 - protein, 235 aa, Homo sapiens
DPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 6784 - protein, 12 aa, Homo sapiens
ERKCCVECPPCP

SEQ ID NO: 6785 - protein, 17 aa, Homo sapiens
ELKTPLGDTTHTCPRCP

SEQ ID NO: 6786 - protein, 61 aa, Homo sapiens
ELKTPLGDTHTCPRCPEPKSCDTPPPCPRCPEPKSCDTPPPCPRCPEPKSCDTPPPCPRCP

SEQ ID NO: 6787 - protein, 230 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 6788 - protein, 230 aa, Homo sapiens
ESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 6789 - protein, 12 aa, Homo sapiens
SPNMVPHAHHAQ

SEQ ID NO: 6790 - protein, 107 aa, Homo sapiens
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6791 - protein, 129 aa, Homo sapiens
ESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6792 - protein, 229 aa, Homo sapiens
ESKYGPPCPSCPAPEFEGGPSVFLFPPKPKDTLMISRTPEVTCVVVDVSQEDPEVQFNWYVDGVEVHQAKTKPREEQFNSTYRVVSVLTVLHQDWLNGKEYKCKVSNKGLPSSIEKTISKAKGQPREPQVYTLPPSQEEMTKNQVSLTCLVKGFVPSDIAVEWESNGQPENNYKTTPPVLDSDGSFFLYSRLTVDKSRWQEGNVFSCSVMHEALHNHYTQKSLSLSLGK

SEQ ID NO: 6793 - protein, 229 aa, Homo sapiens
ESKYGPPCPPCPAPEFEGGPSVFLFPPKPKDTLMISRTPEVTCVVVDVSQEDPEVQFNWYVDGVEVHQAKTKPREEQFNSTYRVVSVLTVLHQDWLNGKEYKCKVSNKGLPSSIEKTISKAKGQPREPQVYTLPPSQEEMTKNQVSLTCLVKGFVPSDIAVEWESNGQPENNYKTTPPVLDSDGSFFLYSRLTVDKSRWQEGNVFSCSVMHEALHNHYTQKSLSLSLGK

SEQ ID NO: 6794 - protein, 230 aa, Homo sapiens; identical to SEQ ID NO: 6787

SEQ ID NO: 6795 - protein, 12 aa, Homo sapiens
ESKYGPPCPPCP

SEQ ID NO: 6796 - protein, 119 aa, Homo sapiens; identical to SEQ ID NO: 6765

SEQ ID NO: 6797 - protein, 229 aa, Homo sapiens; identical to SEQ ID NO: 6764

SEQ ID NO: 6798 - protein, 229 aa, Homo sapiens; identical to SEQ ID NO: 6764

SEQ ID NO: 6799 - protein, 9 aa, Homo sapiens
YGPPCPPCP

SEQ ID NO: 6800 - protein, 10 aa, Homo sapiens
KYGPPCPPCP

SEQ ID NO: 6801 - protein, 13 aa, Homo sapiens
EVVKYGPPCPPCP

SEQ ID NO: 6802 - protein, 229 aa, Homo sapiens
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDLSRWQEGNVFSCSVMHEALHNHYTQKSLSLSLGK

SEQ ID NO: 6803 - protein, 22 aa, Homo sapiens
ESKYGPPCPPCPGGGSSGGGSG

SEQ ID NO: 6804 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 6805 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPLEKTISKAKGQPREPQVYTLPPSRDELTKNQVSLTCLVKGFYPSDIAVEWESNGQPENNYKTIPPVLDSDGSFFLYSKLTVDKSRWQQGNVFSCSVMHEALHNHYTQKSLSLSPGK

SEQ ID NO: 6806 - protein, 231 aa, Homo sapiens; identical to SEQ ID NO: 6780

SEQ ID NO: 6807 - protein, 68 aa, Homo sapiens
TTPAPRPPTPAPTIASQPLSLRPEACRPAAGGAVHTRGLDFACDIYIWAPLAGTCGVLLLSLVITLYC

SEQ ID NO: 6808 - protein, 243 aa, Homo sapiens
DIQMTQSSSYLSVSLGGRVTITCKASDHINNWLAWYQQKPGNAPRLLISGATSLETGVPSRFSGSGSGKDYTLSITSLQTEDVATYYCQQYWSTPFTFGSGTKLEIKGGGGSGGGGSGGGGSQVQLKESGPGLVAPSQSLSITSTVSGFSLSRYSVHWVRQPPGKGLEWLGMIWGGGSTDYNSALKSRLSISKDNSKSQVFLKMNSLQTDDTAMYYCARNEGDTTAGTWFAYWGQGTLVTVSS

SEQ ID NO: 6809 - protein, 62 aa, Homo sapiens
ALSNSIMYFSHFVPVFLPAKPTTTPAPRPPTPAPTIASQPLSLRPEACRPAAGGAVHTRGLD

SEQ ID NO: 6810 - protein, 68 aa, Homo sapiens
TTTPAPRPPTPAPTIASQPLSLRPEACRPAAGGAVHTRGLDFACDIYIWAPLAGTCGVLLLSLVITLY

SEQ ID NO: 6811 - protein, 70 aa, Homo sapiens
KPTTTPAPRPPTPAPTIASQPLSLRPEACRPAAGGAVHTRGLDFACDIYIWAPLAGTCGVLLLSLVITLY

SEQ ID NO: 6812 - protein, 674 aa, Artificial Sequence
  Description of Artificial Sequence: Synthetic Chimeric Antigen Receptor sequence
MALPVTALLLPLALLLHAARPQIQLVQSGPEVKKPGETVKISCKASGYTFTNYGMNWVKQAPGKGLKWMGINTYTGEPTYADAFKGRFAFSLETSASTAYLQINNLKNEDTATYFCARDYGDYGMDYWGQGTSVTVSSGGGGSGGGGSGGGGSDIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6813 - protein, 705 aa, Artificial Sequence
  Description of Artificial Sequence: Synthetic Chimeric Antigen Receptor sequence
ADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSAQLEKKLQALKKKNAQLKWKLQALKKKLAQ

SEQ ID NO: 6814 - protein, 482 aa, Artificial Sequence
  Description of Artificial Sequence: Synthetic Chimeric Antigen Receptor sequence
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6815 - protein, 490 aa, Artificial Sequence
  Description of Artificial Sequence: Synthetic Chimeric Antigen Receptor sequence
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6816 - protein, 730 aa, Artificial Sequence
  Description of Artificial Sequence: Synthetic Chimeric Antigen Receptor sequence
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6817 - protein, 494 aa, Artificial Sequence
  Description of Artificial Sequence: Synthetic Chimeric Antigen Receptor sequence
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6818 - protein, 790 aa, Artificial Sequence
  Description of Artificial Sequence: Synthetic Chimeric Antigen Receptor sequence
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6819 - protein, 554 aa, Artificial Sequence
  Description of Artificial Sequence: Synthetic Chimeric Antigen Receptor sequence
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6820 - protein, 728 aa, Artificial Sequence
  Description of Artificial Sequence: Synthetic Chimeric Antigen Receptor sequence
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6821 - protein, 491 aa, Artificial Sequence
  Description of Artificial Sequence: Synthetic Chimeric Antigen Receptor sequence
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6822 - protein, 732 aa, Artificial Sequence
  Description of Artificial Sequence: Synthetic Chimeric Antigen Receptor sequence
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6823 - protein, 495 aa, Artificial Sequence
  Description of Artificial Sequence: Synthetic Chimeric Antigen Receptor sequence
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6824 - protein, 792 aa, Artificial Sequence
  Description of Artificial Sequence: Synthetic Chimeric Antigen Receptor sequence
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6825 - protein, 555 aa, Artificial Sequence
  Description of Artificial Sequence: Synthetic Chimeric Antigen Receptor sequence
LLVTSLLLCELPHPAFLLIPDTQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGGSGGGGSGGGGSDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6826 - protein, 725 aa, Artificial Sequence
  Description of Artificial Sequence: Synthetic Chimeric Antigen Receptor sequence
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6827 - protein, 489 aa, Artificial Sequence
  Description of Artificial Sequence: Synthetic Chimeric Antigen Receptor sequence
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6828 - protein, 729 aa, Artificial Sequence
  Description of Artificial Sequence: Synthetic Chimeric Antigen Receptor sequence
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6829 - protein, 493 aa, Artificial Sequence
  Description of Artificial Sequence: Synthetic Chimeric Antigen Receptor sequence
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6830 - protein, 789 aa, Artificial Sequence [sequence omitted]

SEQ ID NO: 6831 - protein, 553 aa, Artificial Sequence
  Description of Artificial Sequence: Synthetic Chimeric Antigen Receptor sequence
LLVTSLLLCELPHPAFLLIPDTDVQLQESGPVLVKTGASVKMSCTASGYTFTDHFMDWVKQSHGKSLEWIGSLNPYSGGTSYNQKFKGKATLTVDKSSSTAYMELNSLTSVDSAVYYCARHNWGAYFDYWGQGTTLTVSSGGGGSGGGGSGGGGSDIVMTQAAPSVPVTPGESVSISCRSSKSLLHSNGNTYLYWFLQRPGQSPQRLIYYMSNLASGVPDRFSGRGSGTDFTLRISRVEAEDVGVYYCMQGLEDPYTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6832 - protein, 724 aa, Artificial Sequence
  Description of Artificial Sequence: Synthetic Chimeric Antigen Receptor sequence
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6833 - protein, 487 aa, Artificial Sequence
  Description of Artificial Sequence: Synthetic Chimeric Antigen Receptor sequence
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6834 - protein, 728 aa, Artificial Sequence
  Description of Artificial Sequence: Synthetic Chimeric Antigen Receptor sequence
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6835 - protein, 491 aa, Artificial Sequence
  Description of Artificial Sequence: Synthetic Chimeric Antigen Receptor sequence
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6836 - protein, 788 aa, Artificial Sequence
  Description of Artificial Sequence: Synthetic Chimeric Antigen Receptor sequence
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6837 - protein, 551 aa, Artificial Sequence
  Description of Artificial Sequence: Synthetic Chimeric Antigen Receptor sequence
LLVTSLLLCELPHPAFLLIPDTALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGGSGGGGSGGGGSDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6838 - protein, 728 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6839 - protein, 492 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6840 - protein, 732 aa, Artificial Sequence [sequence omitted]

SEQ ID NO: 6841 - protein, 496 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6842 - protein, 792 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6843 - protein, 556 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGFSLTSYAISWVRQAPGQGLEWMGGIIWSGGATNYAQKFQGRVTITADESTSTAYMELSSLRSEDTAVYYCAREHYYGSSAMDYWWGQGTMVTVSSGGGGSGGGGSGGGGSEIVLTQSPATLSLSPGERATLSCRASQSIVHSYGNTYAWYQQKPGQAPRLLIYRVSRATGIPARFSGSGSGTDFTLTISSLEPEDFAVYYCFQGTHVPYTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6844 - protein, 728 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6845 - protein, 491 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6846 - protein, 732 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6847 - protein, 495 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6848 - protein, 792 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6849 - protein, 555 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYAFSSYISWVRQAPGQGLEWMGGQIYPGDGDTNYAQKFQGRVTITADESTSTAYMELSSLRSEDTAVYYCVRYYYGSSGYFDYWWGQGTMVTVSSGGGGSGGGGSGGGGSEIVLTQSPATLSLSPGERATLSCRASESVDNYGISFAWYQQKPGQAPRLLIYRASRATGIPARFSGSGSGTDFTLTISSLEPEDFAVYYCQQNNKDPPTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6850 - protein, 726 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6851 - protein, 490 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6852 - protein, 730 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6853 - protein, 494 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6854 - protein, 790 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6855 - protein, 554 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDHFISWVRQAPGQGLEWMGGLNPYSGGTNYAQKFQGRVTITADESTSTAYMELSSLRSEDTAVYYCARHNWGAYFDYWWGQGTMVTVSSGGGGSGGGGSGGGGSEIVLTQSPATLSLSPGERATLSCRASKSLLHSNGNTYAWYQQKPGQAPRLLIYYMSRATGIPARFSGSGSGTDFTLTISSLEPEDFAVYYCMQGLEDPYTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6856 - protein, 724 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6857 - protein, 487 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6858 - protein, 728 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6859 - protein, 491 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6860 - protein, 788 aa, Artificial Sequence [sequence omitted]

SEQ ID NO: 6861 - protein, 551 aa, Artificial Sequence
  Description of Artificial Sequence: Synthetic Chimeric Antigen Receptor sequence
LLVTSLLLCELPHPAFLLIPDTQVQLQQSGAEVKKPGSSVKVSCKASGYTFTDYEISWVRQAPGQGLEWMGGIDPETGGTNYAQKFQGRVTITADESTSTAYMELSSLRSEDTAVYYCARRRYYGSSSFDYWWGQGTMVTVSSGGGGSGGGGSGGGGSEIVLTQSPATLSLSPGERATLSCRASQDIGNYAWYQQKPGQAPRLLIYYTSRATGIPARFSGSGSGTDFTLTISSLEPEDFAVYYCQQGSALPPTFFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6862 - protein, 493 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6863 - protein, 398 aa, Artificial Sequence
  Description of Artificial Sequence: Synthetic Chimeric Antigen Receptor sequence
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6864 - protein, 614 aa, Artificial Sequence
  Description of Artificial Sequence: Synthetic Chimeric Antigen Receptor sequence
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6865 - protein, 482 aa, Artificial Sequence; identical to SEQ ID NO: 6814
  Description of Artificial Sequence: Synthetic Chimeric Antigen Receptor sequence

SEQ ID NO: 6866 - protein, 493 aa, Artificial Sequence
  Description of Artificial Sequence: Synthetic Chimeric Antigen Receptor sequence
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6867 - protein, 489 aa, Artificial Sequence
  Description of Artificial Sequence: Synthetic Chimeric Antigen Receptor sequence
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRAFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6868 - protein, 491 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6869 - protein, 489 aa, Artificial Sequence
  Description of Artificial Sequence: Synthetic Chimeric Antigen Receptor sequence
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLWYQQKPGQAPRLLIYGASRRATGIPDRFSGSGSGTDFTLTISRLEPEDSAVYYCQQYHSSPSWIFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6870 - protein, 488 aa, Artificial Sequence
  Description of Artificial Sequence: Synthetic Chimeric Antigen Receptor sequence
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6871 - protein, 483 aa, Artificial Sequence
  Description of Artificial Sequence: Synthetic Chimeric Antigen Receptor sequence
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6872 - protein, 485 aa, Artificial Sequence
  Description of Artificial Sequence: Synthetic Chimeric Antigen Receptor sequence
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6873 - protein, 483 aa, Artificial Sequence
  Description of Artificial Sequence: Synthetic Chimeric Antigen Receptor sequence
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6874 - protein, 483 aa, Artificial Sequence
  Description of Artificial Sequence: Synthetic Chimeric Antigen Receptor sequence
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6875 - protein, 490 aa, Artificial Sequence
  Description of Artificial Sequence: Synthetic Chimeric Antigen Receptor sequence
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGIFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6876 - protein, 487 aa, Artificial Sequence
  Description of Artificial Sequence: Synthetic Chimeric Antigen Receptor sequence
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6877 - protein, 483 aa, Artificial Sequence
  Description of Artificial Sequence: Synthetic Chimeric Antigen Receptor sequence
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6878 - protein, 484 aa, Artificial Sequence
  Description of Artificial Sequence: Synthetic Chimeric Antigen Receptor sequence
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6879 - protein, 485 aa, Artificial Sequence
  Description of Artificial Sequence: Synthetic Chimeric Antigen Receptor sequence
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6880 - protein, 487 aa, Artificial Sequence
  Description of Artificial Sequence: Synthetic Chimeric Antigen Receptor sequence
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6881 - protein, 488 aa, Artificial Sequence
  Description of Artificial Sequence: Synthetic Chimeric Antigen Receptor sequence
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6882 - protein, 490 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYIFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6883 - protein, 484 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6884 - protein, 485 aa, Artificial Sequence
  Description of Artificial Sequence: Synthetic Chimeric Antigen Receptor sequence
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6885 - protein, 488 aa, Artificial Sequence
  Description of Artificial Sequence: Synthetic Chimeric Antigen Receptor sequence
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6886 - protein, 497 aa, Artificial Sequence
  Description of Artificial Sequence: Synthetic Chimeric Antigen Receptor sequence
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6887 - protein, 492 aa, Artificial Sequence
  Description of Artificial Sequence: Synthetic Chimeric Antigen Receptor sequence
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6888 - protein, 461 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6889 - protein, 464 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6890 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6891 - protein, 493 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6892 - protein, 676 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6893 - protein, 679 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6894 - protein, 461 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6895 - protein, 464 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6896 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6897 - protein, 493 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6898 - protein, 676 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6899 - protein, 679 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6900 - protein, 436 aa, Artificial Sequence
  Description of Artificial Sequence: Synthetic Chimeric Antigen Receptor sequence
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6901 - protein, 439 aa, Artificial Sequence
  Description of Artificial Sequence: Synthetic Chimeric Antigen Receptor sequence
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6902 - protein, 465 aa, Artificial Sequence
  Description of Artificial Sequence: Synthetic Chimeric Antigen Receptor sequence
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6903 - protein, 468 aa, Artificial Sequence
  Description of Artificial Sequence: Synthetic Chimeric Antigen Receptor sequence
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6904 - protein, 651 aa, Artificial Sequence
  Description of Artificial Sequence: Synthetic Chimeric Antigen Receptor sequence
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6905 - protein, 654 aa, Artificial Sequence
  Description of Artificial Sequence: Synthetic Chimeric Antigen Receptor sequence
EVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6906 - protein, 434 aa, Artificial Sequence
  Description of Artificial Sequence: Synthetic Chimeric Antigen Receptor sequence
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6907 - protein, 437 aa, Artificial Sequence
  Description of Artificial Sequence: Synthetic Chimeric Antigen Receptor sequence
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6908 - protein, 463 aa, Artificial Sequence
  Description of Artificial Sequence: Synthetic Chimeric Antigen Receptor sequence
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6909 - protein, 466 aa, Artificial Sequence
  Description of Artificial Sequence: Synthetic Chimeric Antigen Receptor sequence
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6910 - protein, 649 aa, Artificial Sequence
  Description of Artificial Sequence: Synthetic Chimeric Antigen Receptor sequence
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6911 - protein, 650 aa, Artificial Sequence
  Description of Artificial Sequence: Synthetic Chimeric Antigen Receptor sequence
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALP

SEQ ID NO: 6912 - protein, 444 aa, Artificial Sequence
  Description of Artificial Sequence: Synthetic Chimeric Antigen Receptor sequence
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6913 - protein, 447 aa, Artificial Sequence
  Description of Artificial Sequence: Synthetic Chimeric Antigen Receptor sequence
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6914 - protein, 473 aa, Artificial Sequence
  Description of Artificial Sequence: Synthetic Chimeric Antigen Receptor sequence
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6915 - protein, 476 aa, Artificial Sequence
  Description of Artificial Sequence: Synthetic Chimeric Antigen Receptor sequence
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6916 - protein, 659 aa, Artificial Sequence
  Description of Artificial Sequence: Synthetic Chimeric Antigen Receptor sequence
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6917 - protein, 662 aa, Artificial Sequence
  Description of Artificial Sequence: Synthetic Chimeric Antigen Receptor sequence
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6918 - protein, 440 aa, Artificial Sequence
  Description of Artificial Sequence: Synthetic Chimeric Antigen Receptor sequence
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6919 - protein, 443 aa, Artificial Sequence
  Description of Artificial Sequence: Synthetic Chimeric Antigen Receptor sequence
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6920 - protein, 469 aa, Artificial Sequence
  Description of Artificial Sequence: Synthetic Chimeric Antigen Receptor sequence
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6921 - protein, 472 aa, Artificial Sequence
  Description of Artificial Sequence: Synthetic Chimeric Antigen Receptor sequence
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6922 - protein, 655 aa, Artificial Sequence
  Description of Artificial Sequence: Synthetic Chimeric Antigen Receptor sequence
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6923 - protein, 658 aa, Artificial Sequence
  Description of Artificial Sequence: Synthetic Chimeric Antigen Receptor sequence
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6924 - protein, 657 aa, Artificial Sequence
  Description of Artificial Sequence: Synthetic Chimeric Antigen Receptor sequence
QVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPP

SEQ ID NO: 6925 - protein, 490 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFIFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6926 - protein, 492 aa, Artificial Sequence
  Description of Artificial Sequence: Synthetic Chimeric Antigen Receptor sequence
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6927 - protein, 483 aa, Artificial Sequence
  Description of Artificial Sequence: Synthetic Chimeric Antigen Receptor sequence
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6928 - protein, 488 aa, Artificial Sequence
  Description of Artificial Sequence: Synthetic Chimeric Antigen Receptor sequence
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6929 - protein, 489 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLWYQQKPGQAPRLLIYGASGRATGIPDRFSGSGSGTDFTLTISRLEPEDFAVYYCQHYGGSPRLIFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6930 - protein, 490 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6931 - protein, 489 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLWYQQRPGQAPRLLIYGASQRATGIPDRFSGRGSGTDFTLTISRVEPEDSAVYYCQHYESSPSWIFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6932 - protein, 492 aa, Artificial Sequence
  Description of Artificial Sequence: Synthetic Chimeric Antigen Receptor sequence
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6933 - protein, 488 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6934 - protein, 486 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6935 - protein, 486 aa, Artificial Sequence; identical to SEQ ID NO: 6934
  Description of Artificial Sequence: Synthetic Chimeric Antigen Receptor sequence

SEQ ID NO: 6936 - protein, 495 aa, Artificial Sequence
  Description of Artificial Sequence: Synthetic Chimeric Antigen Receptor sequence
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6937 - protein, 483 aa, Artificial Sequence; identical to SEQ ID NO: 6874
  Description of Artificial Sequence: Synthetic Chimeric Antigen Receptor sequence

SEQ ID NO: 6938 - protein, 490 aa, Artificial Sequence
  Description of Artificial Sequence: Synthetic Chimeric Antigen Receptor sequence
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6939 - protein, 488 aa, Artificial Sequence; identical to SEQ ID NO: 6870
  Description of Artificial Sequence: Synthetic Chimeric Antigen Receptor sequence

SEQ ID NO: 6940 - protein, 487 aa, Artificial Sequence; identical to SEQ ID NO: 6876
  Description of Artificial Sequence: Synthetic Chimeric Antigen Receptor sequence

SEQ ID NO: 6941 - protein, 493 aa, Artificial Sequence; identical to SEQ ID NO: 6866
  Description of Artificial Sequence: Synthetic Chimeric Antigen Receptor sequence

SEQ ID NO: 6942 - protein, 490 aa, Artificial Sequence
  Description of Artificial Sequence: Synthetic Chimeric Antigen Receptor sequence
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6943 - protein, 491 aa, Artificial Sequence; identical to SEQ ID NO: 6868
  Description of Artificial Sequence: Synthetic Chimeric Antigen Receptor sequence

SEQ ID NO: 6944 - protein, 482 aa, Artificial Sequence; identical to SEQ ID NO: 6814
  Description of Artificial Sequence: Synthetic Chimeric Antigen Receptor sequence

SEQ ID NO: 6945 - protein, 483 aa, Artificial Sequence; identical to SEQ ID NO: 6871
  Description of Artificial Sequence: Synthetic Chimeric Antigen Receptor sequence

SEQ ID NO: 6946 - protein, 485 aa, Artificial Sequence; identical to SEQ ID NO: 6872
  Description of Artificial Sequence: Synthetic Chimeric Antigen Receptor sequence

SEQ ID NO: 6947 - protein, 483 aa, Artificial Sequence; identical to SEQ ID NO: 6873
  Description of Artificial Sequence: Synthetic Chimeric Antigen Receptor sequence

SEQ ID NO: 6948 - protein, 490 aa, Artificial Sequence
  Description of Artificial Sequence: Synthetic Chimeric Antigen Receptor sequence
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6949 - protein, 483 aa, Artificial Sequence; identical to SEQ ID NO: 6877
  Description of Artificial Sequence: Synthetic Chimeric Antigen Receptor sequence

SEQ ID NO: 6950 - protein, 484 aa, Artificial Sequence; identical to SEQ ID NO: 6878
  Description of Artificial Sequence: Synthetic Chimeric Antigen Receptor sequence

SEQ ID NO: 6951 - protein, 485 aa, Artificial Sequence; identical to SEQ ID NO: 6879
  Description of Artificial Sequence: Synthetic Chimeric Antigen Receptor sequence

SEQ ID NO: 6952 - protein, 487 aa, Artificial Sequence; identical to SEQ ID NO: 6880
  Description of Artificial Sequence: Synthetic Chimeric Antigen Receptor sequence

SEQ ID NO: 6953 - protein, 489 aa, Artificial Sequence
  Description of Artificial Sequence: Synthetic Chimeric Antigen Receptor sequence
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6954 - protein, 490 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6955 - protein, 484 aa, Artificial Sequence; identical to SEQ ID NO: 6883
  Description of Artificial Sequence: Synthetic Chimeric Antigen Receptor sequence

SEQ ID NO: 6956 - protein, 485 aa, Artificial Sequence; identical to SEQ ID NO: 6884
  Description of Artificial Sequence: Synthetic Chimeric Antigen Receptor sequence

SEQ ID NO: 6957 - protein, 489 aa, Artificial Sequence
  Description of Artificial Sequence: Synthetic Chimeric Antigen Receptor sequence
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6958 - protein, 497 aa, Artificial Sequence; identical to SEQ ID NO: 6886
  Description of Artificial Sequence: Synthetic Chimeric Antigen Receptor sequence

SEQ ID NO: 6959 - protein, 492 aa, Artificial Sequence; identical to SEQ ID NO: 6887
  Description of Artificial Sequence: Synthetic Chimeric Antigen Receptor sequence

SEQ ID NO: 6960 - protein, 490 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6961 - protein, 485 aa, Artificial Sequence
  Description of Artificial Sequence: Synthetic Chimeric Antigen Receptor sequence
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6962 - protein, 492 aa, Artificial Sequence; identical to SEQ ID NO: 6932
  Description of Artificial Sequence: Synthetic Chimeric Antigen Receptor sequence

SEQ ID NO: 6963 - protein, 212 aa, Artificial Sequence
  Description of Artificial Sequence: Synthetic Chimeric Antigen Receptor sequence
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGS

SEQ ID NO: 6964 - protein, 483 aa, Artificial Sequence; identical to SEQ ID NO: 6927
  Description of Artificial Sequence: Synthetic Chimeric Antigen Receptor sequence

SEQ ID NO: 6965 - protein, 490 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6966 - protein, 485 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6967 - protein, 486 aa, Artificial Sequence; identical to SEQ ID NO: 6934
  Description of Artificial Sequence: Synthetic Chimeric Antigen Receptor sequence

SEQ ID NO: 6968 - protein, 492 aa, Artificial Sequence
  Description of Artificial Sequence: Synthetic Chimeric Antigen Receptor sequence
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6969 - protein, 488 aa, Artificial Sequence; identical to SEQ ID NO: 6928
  Description of Artificial Sequence: Synthetic Chimeric Antigen Receptor sequence

SEQ ID NO: 6970 - protein, 488 aa, Artificial Sequence; identical to SEQ ID NO: 6933
  Description of Artificial Sequence: Synthetic Chimeric Antigen Receptor sequence

SEQ ID NO: 6971 - protein, 495 aa, Artificial Sequence; identical to SEQ ID NO: 6936
  Description of Artificial Sequence: Synthetic Chimeric Antigen Receptor sequence

SEQ ID NO: 6972 - protein, 490 aa, Artificial Sequence; identical to SEQ ID NO: 6930
  Description of Artificial Sequence: Synthetic Chimeric Antigen Receptor sequence

SEQ ID NO: 6973 - protein, 467 aa, Artificial Sequence
  Description of Artificial Sequence: Synthetic Chimeric Antigen Receptor sequence
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6974 - protein, 472 aa, Artificial Sequence
  Description of Artificial Sequence: Synthetic Chimeric Antigen Receptor sequence
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6975 - protein, 466 aa, Artificial Sequence
  Description of Artificial Sequence: Synthetic Chimeric Antigen Receptor sequence
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6976 - protein, 466 aa, Artificial Sequence
  Description of Artificial Sequence: Synthetic Chimeric Antigen Receptor sequence
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6977 - protein, 466 aa, Artificial Sequence; identical to SEQ ID NO: 6976
  Description of Artificial Sequence: Synthetic Chimeric Antigen Receptor sequence

SEQ ID NO: 6978 - protein, 422 aa, Artificial Sequence
  Description of Artificial Sequence: Synthetic Chimeric Antigen Receptor sequence
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKAEAYSEIGMKGERRRGKGHDGLYQGLSTATKDYDALHMQALPPR

SEQ ID NO: 6979 - protein, 394 aa, Artificial Sequence
  Description of Artificial Sequence: Synthetic Chimeric Antigen Receptor sequence
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVLSGGGSDPAEPKSPDKTHTCPPCPDPFWVLWVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6980 - protein, 630 aa, Artificial Sequence
  Description of Artificial Sequence: Synthetic Chimeric Antigen Receptor sequence
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEALHNHYTQKSLSLSPGKKDPKFWVLWVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEGGKPRRKNPQEGLYNELQKDKMAEAYSEIGMKGERRRGKGHDGLYQGLSTATKDTYDALHMQALPPR

SEQ ID NO: 6981 - protein, 438 aa, Artificial Sequence
  Description of Artificial Sequence: Synthetic Chimeric Antigen Receptor sequence
MGTSLLCMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQWSREGQGRQETLFRCIRSMPSHPDRAYNSCYSAGVFHLHQGDILSIIPRARAKLNLSPHGTFLGFVKLSGGGSDPTTTPAPRPPTPAPTIASQPLSLRPEACRPAAGGAVHTRGLDFACDIFWVLWVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSATKDTYDALHMQALPPR

SEQ ID NO: 6982 - protein, 416 aa, Artificial Sequence
  Description of Artificial Sequence: Synthetic Chimeric Antigen Receptor sequence
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPKDPKFWVLVVVGGVLACYSLLVTVAFIIFVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6983 - protein, 614 aa, Artificial Sequence; identical to SEQ ID NO: 6864
  Description of Artificial Sequence: Synthetic Chimeric Antigen Receptor sequence

SEQ ID NO: 6984 - protein, 424 aa, Artificial Sequence
  Description of Artificial Sequence: Synthetic Chimeric Antigen Receptor sequence
METDTLLLWVLLLWVPGSTGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6985 - protein, 398 aa, Artificial Sequence; identical to SEQ ID NO: 6863
  Description of Artificial Sequence: Synthetic Chimeric Antigen Receptor sequence

SEQ ID NO: 6986 - protein, 633 aa, Artificial Sequence
  Description of Artificial Sequence: Synthetic Chimeric Antigen Receptor sequence
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVEHLHQGDILSVIIPRARAKLNLSPHGTFLGFVKLSGGGSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6987 - protein, 443 aa, Artificial Sequence
  Description of Artificial Sequence: Synthetic Chimeric Antigen Receptor sequence
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6988 - protein, 417 aa, Artificial Sequence
  Description of Artificial Sequence: Synthetic Chimeric Antigen Receptor sequence
MGTSLLCWMALCLLGADHADGKPIPNPLLGLDSTSGGGGSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLSGGGSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6989 - protein, 391 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAIELLPVPGAKKSAKLYIPYIILTIIILTIVGFIWLLKVNGCRKYKLNKTESTPVVEEDEMQPYASYTEKNNPLYDTTNKVKASEALQSEVDTDLHTLSHG

SEQ ID NO: 6990 - protein, 503 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6991 - protein, 503 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6992 - protein, 503 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6993 - protein, 507 aa, Artificial Sequence
  Description of Artificial Sequence: Synthetic Chimeric Antigen Receptor sequence
MLLLVTSLLLCELPHPAFLLIPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6994 - protein, 506 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6995 - protein, 512 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6996 - protein, 502 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6997 - protein, 549 aa, Artificial Sequence
  Description of Artificial Sequence: Synthetic Chimeric Antigen Receptor sequence
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6998 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6999 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGESVKVSCKASGYTFTDYSINWVRQAPGQGLEWMGWINTETREPAYAYDFRGRFVFSLDTSVSTAYLQISSLKAEDTAVYYCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7000 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGESVKISCKASGYTFTDYSINWVRQAPGQGLEWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7001 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7002 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQIQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7003 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7004 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGESVKVSCKASGYTFTDYSINWVRQAPGQGLEWMGWINTETREPAYAYDFRGRFVFSLDTSVSTAYLQISSLKAEDTAVYYCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7005 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGESVKISCKASGYTFTDYSINWVRQAPGQGLEWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7006 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7007 - protein, 493 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYSCLQSRIFPRTFGQGTKLEIKGSTSGSGKPGSGEGSTKGQIQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7008 - protein, 493 aa, Artificial Sequence
  Description of Artificial Sequence: Synthetic Chimeric Antigen Receptor sequence
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7009 - protein, 493 aa, Artificial Sequence
  Description of Artificial Sequence: Synthetic Chimeric Antigen Receptor sequence
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGESVKVSCKASGYTFTDYSINWVRQAPGQGLEWMGWINTETREPAYAYDFRGRFVFSLDTSVSTAYLQISSLKAEDTAVYYCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7010 - protein, 493 aa, Artificial Sequence
  Description of Artificial Sequence: Synthetic Chimeric Antigen Receptor sequence
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGESVKISCKASGYTFTDYSINWVRQAPGQGLEWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7011 - protein, 493 aa, Artificial Sequence
  Description of Artificial Sequence: Synthetic Chimeric Antigen Receptor sequence
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7012 - protein, 493 aa, Artificial Sequence
  Description of Artificial Sequence: Synthetic Chimeric Antigen Receptor sequence
MALPVTALLLPLALLLHAARPDIVLTQSPASLAMSLGERATISCRASESVSVIGAHLIHWYQQKPGQPPKLLIYLASNLETGVPARFSGSGSGTDFTLTISRVQAEDAAIYSCLQSRIFPRTFGQGTKLEIKGSTSGSGKPGSGEGSTKGQIQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7013 - protein, 487 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAADTGLYICKVELMYPPPYYLGIGNGTQIYVIDPEPCPDSDFLLWILAAVSSGLFFYSFLLTAVSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7014 - protein, 485 aa, Artificial Sequence
  Description of Artificial Sequence: Synthetic Chimeric Antigen Receptor sequence
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGSTSGSGKPGSGEGSTKGQVQLVQSGSELKKPGASVKVSCKASGYTFTDYSINWVRQAPGQGLEWMGWINTETREPAYAYDFRGRFVFSLDTSVSTAYLQISSLKAEDTAVYYCARDYSYAMDYWGQGTLVTVSSAAAQIKESLRAELRVTERRAEVPTAHPSPSPRPAGQFQTLVVGVVGGLLGSLVLLVWVLAVICSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7015 - protein, 464 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7016 - protein, 498 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7017 - protein, 513 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSCPYSNPSLCSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7018 - protein, 522 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSELPTQGTFSNVSTNVSPAKPTTTACPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7019 - protein, 500 aa, Artificial Sequence
  Description of Artificial Sequence: Synthetic Chimeric Antigen Receptor sequence
GGGGSCPYSNPSLCSGGGGSCPYSNPSLCSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7020 - protein, 466 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7021 - protein, 472 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7022 - protein, 491 aa, Artificial Sequence
  Description of Artificial Sequence: Synthetic Chimeric Antigen Receptor sequence
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7023 - protein, 497 aa, Artificial Sequence
  Description of Artificial Sequence: Synthetic Chimeric Antigen Receptor sequence
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7024 - protein, 490 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7025 - protein, 496 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7026 - protein, 514 aa, Artificial Sequence
  Description of Artificial Sequence: Synthetic Chimeric Antigen Receptor sequence
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7027 - protein, 515 aa, Artificial Sequence
  Description of Artificial Sequence: Synthetic Chimeric Antigen Receptor sequence
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7028 - protein, 521 aa, Artificial Sequence
  Description of Artificial Sequence: Synthetic Chimeric Antigen Receptor sequence
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGGSCPYSNPSLCSGGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7029 - protein, 504 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7030 - protein, 547 aa, Artificial Sequence
  Description of Artificial Sequence: Synthetic Chimeric Antigen Receptor sequence
GGGGSCPYSNPSLCSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSELPTQGTFSNVSTNVSPAKPTTTACPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7031 - protein, 523 aa, Artificial Sequence
  Description of Artificial Sequence: Synthetic Chimeric Antigen Receptor sequence
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGSCPYSNPSLCSGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKSDPGSGGGGSCPYSNPSLCSGGGGSELPTQGTFSNVSTNVSPAKPTTTACPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7032 - protein, 469 aa, Artificial Sequence
  Description of Artificial Sequence: Synthetic Chimeric Antigen Receptor sequence
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7033 - protein, 485 aa, Artificial Sequence
  Description of Artificial Sequence: Synthetic Chimeric Antigen Receptor sequence
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7034 - protein, 491 aa, Artificial Sequence
  Description of Artificial Sequence: Synthetic Chimeric Antigen Receptor sequence
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7035 - protein, 500 aa, Artificial Sequence
  Description of Artificial Sequence: Synthetic Chimeric Antigen Receptor sequence
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCSGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7036 - protein, 506 aa, Artificial Sequence
  Description of Artificial Sequence: Synthetic Chimeric Antigen Receptor sequence
QVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7037 - protein, 136 aa, Artificial Sequence
  Description of Artificial Sequence: Synthetic Chimeric Antigen Receptor sequence
CPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 7038 - protein, 449 aa, Artificial Sequence
  Description of Artificial Sequence: Synthetic Chimeric Antigen Receptor sequence
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7039 - protein, 430 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQSHG

SEQ ID NO: 7040 - protein, 391 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVQAPSSSPMGIIVAVVTGIAVAAIVAAVVALIYCRKKRISALPGYPECREMGETLPEKPANPTNPDEADKVGAENTITYSLLMHPDALEEPDDQNRISHG

SEQ ID NO: 7041 - protein, 432 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAMSHG

SEQ ID NO: 7042 - protein, 415 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKSSHG

SEQ ID NO: 7043 - protein, 465 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGTSRNRTGLTAAGITGLVLSILVLAAAAALLHYARARRKPGGLSATGTSSHSPSECQEPSSSRPSRIDPQEPTHSKPLAPMELEPMYSNANPGDSNPIYSQIWSIQHTKENSANCPMMHQEHEELTVLYSELKKTHPDDSAGEASSRGRAHEEDDEENYENVPRVLLASDHSHG

SEQ ID NO: 7044 - protein, 435 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEESSHG

SEQ ID NO: 7045 - protein, 437 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHRSHG

SEQ ID NO: 7046 - protein, 437 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCPSHG

SEQ ID NO: 7047 - protein, 437 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCPSHG

SEQ ID NO: 7048 - protein, 430 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEPSHG

SEQ ID NO: 7049 - protein, 469 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSDASDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGISHG

SEQ ID NO: 7050 - protein, 469 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGISHG

SEQ ID NO: 7051 - protein, 438 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCPSHG

SEQ ID NO: 7052 - protein, 449 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVFSHG

SEQ ID NO: 7053 - protein, 409 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSASFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSVSHG

SEQ ID NO: 7054 - protein, 473 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIHSHG

SEQ ID NO: 7055 - protein, 506 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIHSHG

SEQ ID NO: 7056 - protein, 524 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIHSHG

SEQ ID NO: 7057 - protein, 466 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIHSHG

SEQ ID NO: 7058 - protein, 424 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNFSHG

SEQ ID NO: 7059 - protein, 417 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKNSHG

SEQ ID NO: 7060 - protein, 431 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKYPLTFGAGTMLDLKRAAATERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSH

SEQ ID NO: 7061 - protein, 437 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSHG

SEQ ID NO: 7062 - protein, 441 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGTSHG

SEQ ID NO: 7063 - protein, 447 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPKAPPSHRPLKSPQNETLYSVLKASHG

SEQ ID NO: 7064 - protein, 383 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVKEGPPSEHSGISRNAIIFLVLGILVFLILLGIGIYFYWSKCSREVLWHCHLCPSSTEHASASANGHVSYSAVSRENSSSQDPQTEGTRSHG

SEQ ID NO: 7065 - protein, 550 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQSHG

SEQ ID NO: 7066 - protein, 540 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPKSHG

SEQ ID NO: 7067 - protein, 427 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPKSHG

SEQ ID NO: 7068 - protein, 515 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVYSLPQLLGPSCSWEAEGLHCRCSFRAWPAPSLCWRLEEKPLEGNSSQGSFKVNSSSPGPWANSSLILHGGLNSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSKSHG

SEQ ID NO: 7069 - protein, 414 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHKSHG

SEQ ID NO: 7070 - protein, 425 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPKSHG

SEQ ID NO: 7071 - protein, 449 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRGSHG

SEQ ID NO: 7072 - protein, 421 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSALQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHRSHG

SEQ ID NO: 7073 - protein, 533 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHG

SEQ ID NO: 7074 - protein, 556 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHG

SEQ ID NO: 7075 - protein, 500 aa, Artificial Sequence
  Description of Artificial Sequence: Synthetic Chimeric Antigen Receptor sequence
MALPVTALLLPLALLLHAARPGSGSGAQAAQVQLVQSGAEVKKPGASVKVSCKASGYSFPDYYINWVRQAPGQGLEWMGWIYFASGNSEYNQKFTGRVTMTRDTSSSTAYMELSSLRSEDTAVYFCASLYDYDWYFDVWGQGTMVTVSSGGGGSGGGGSGGGGSDIVMTQTPLSLSVTPGEPASISCKSSQSLVHSNGNTYLHWYLQKPGQSPQLLIYKVSNRFSGVPDRFSGSGSGADFTLKISRVEAEDVGVYYCAETSHVPWTFGQGTKLEIKRSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHG

SEQ ID NO: 7076 - protein, 741 aa, Artificial Sequence
  Description of Artificial Sequence: Synthetic Chimeric Antigen Receptor sequence
MSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLNRAEGRGSLLTCGDVEENPGPMALPVTALLLPLALLLHAARPEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7077 - protein, 378 aa, Artificial Sequence
  Description of Artificial Sequence: Synthetic Chimeric Antigen Receptor sequence
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 7078 - protein, 1352 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKIVINSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 7079 - protein, 1341 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTEGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIEWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMETDTLLLWVLLLWVPGSTGQVTLKESGPGILKPSQTLSLTCSFSGESLSTSGMGVGWIRQPSGKGLEWLAHIWWDDDVYYNPSLKNQLTISKDASRDQVFLKITNLDTADTATYYCVRRRATGTGEDYWGQGTTLTVSSGGGGSGGGGSGGGGSNIVMTQSHKFMSTSVGDRVSIACKASQDVGTAVAWYQQKPGQSPKLLIYWTSTRHTGVPDRFTGSGSGTDFTLTITNVQSEDLADYFCHQYNSYNTFGSGTRLELKRSDPAEPKSPDKTHTCPPCPAPPVAGPSVFLEPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVESCSVMHEALHNHYTQKSLSLSPGKKDPKAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 7080 - protein, 1342 aa, Artificial Sequence [sequence omitted]

SEQ ID NO: 7081 - protein, 1341 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTEGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMETDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITEGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTEGKTNGYIA

SEQ ID NO: 7082 - protein, 1341 aa, Artificial Sequence [sequence omitted]

SEQ ID NO: 7083 - protein, 1113 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDIYWAPLAGICVALLLSLIITLICYHRSRKRVCKSGGGSFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRIGTIIVIDMLMENISTKGLDCDIDIQKTIQMVRAQRSGMVQTEAQYKFIYVAIAQFIETTKKKL

SEQ ID NO: 7084 - protein, 918 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPITTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 7085 - protein, 1114 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDIYWAPLAGICVALLLSLIITLICYHRSRKRVCKSGGGSFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKL

SEQ ID NO: 7086 - protein, 918 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 7087 - protein, 1362 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPTTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARHRAEGRGSLLTCGDVEENPGPWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYSGGGGSFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIASGS

SEQ ID NO: 7088 - protein, 1129 aa, Artificial Sequence [sequence omitted]

SEQ ID NO: 7089 - protein, 487 aa, Artificial Sequence
  Description of Artificial Sequence: Synthetic Chimeric Antigen Receptor sequence
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7090 - protein, 483 aa, Artificial Sequence
  Description of Artificial Sequence: Synthetic Chimeric Antigen Receptor sequence
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7091 - protein, 488 aa, Artificial Sequence
  Description of Artificial Sequence: Synthetic Chimeric Antigen Receptor sequence
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7092 - protein, 527 aa, Artificial Sequence
  Description of Artificial Sequence: Synthetic Chimeric Antigen Receptor sequence
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7093 - protein, 484 aa, Artificial Sequence
  Description of Artificial Sequence: Synthetic Chimeric Antigen Receptor sequence
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7094 - protein, 487 aa, Artificial Sequence
  Description of Artificial Sequence: Synthetic Chimeric Antigen Receptor sequence
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7095 - protein, 513 aa, Artificial Sequence
  Description of Artificial Sequence: Synthetic Chimeric Antigen Receptor sequence
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7096 - protein, 516 aa, Artificial Sequence
  Description of Artificial Sequence: Synthetic Chimeric Antigen Receptor sequence
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7097 - protein, 699 aa, Artificial Sequence
  Description of Artificial Sequence: Synthetic Chimeric Antigen Receptor sequence
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7098 - protein, 702 aa, Artificial Sequence
  Description of Artificial Sequence: Synthetic Chimeric Antigen Receptor sequence
MGWSWIFLFLVSGTGGVLSEVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASGGGGSGGGGSGGGGSMESQTQVLMSLLFWVSGTCGDFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7099 - protein, 510 aa, Artificial Sequence
  Description of Artificial Sequence: Synthetic Chimeric Antigen Receptor sequence
WTWRFLFVVAAATGVQSQVQLLQSGAEVKKPGSSVKVSCKASGGTFSTYAISWVRQAPGQGLEWMGGIIPIFGIVNYAQKFQGRVTITADESTSTAYMELSSLRSEDTAVYYCARGGGSGPDVLDIWGQGTMVTVSSASTGGGGSGGGGSGGGGSMDMRVPAQLLGLLLLWLPGARCVIWMTQSPSLLSASTGDRVTISCRMSQGIRSYLAWYQQKPGKAPELLIYAASTLQSGVPSRFSGSGSGTDFTLTISSLQSEDFATYYCQQYYSFPYTFGQGTKLEIKRTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7100 - protein, 431 aa, Artificial Sequence
  Description of Artificial Sequence: Synthetic Chimeric Antigen Receptor sequence
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7101 - protein, 434 aa, Artificial Sequence
  Description of Artificial Sequence: Synthetic Chimeric Antigen Receptor sequence
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7102 - protein, 460 aa, Artificial Sequence
  Description of Artificial Sequence: Synthetic Chimeric Antigen Receptor sequence
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7103 - protein, 463 aa, Artificial Sequence
  Description of Artificial Sequence: Synthetic Chimeric Antigen Receptor sequence
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7104 - protein, 646 aa, Artificial Sequence
  Description of Artificial Sequence: Synthetic Chimeric Antigen Receptor sequence
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7105 - protein, 649 aa, Artificial Sequence
  Description of Artificial Sequence: Synthetic Chimeric Antigen Receptor sequence
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7106 - protein, 438 aa, Artificial Sequence
  Description of Artificial Sequence: Synthetic Chimeric Antigen Receptor sequence
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7107 - protein, 441 aa, Artificial Sequence
  Description of Artificial Sequence: Synthetic Chimeric Antigen Receptor sequence
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7108 - protein, 467 aa, Artificial Sequence
  Description of Artificial Sequence: Synthetic Chimeric Antigen Receptor sequence
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7109 - protein, 470 aa, Artificial Sequence
  Description of Artificial Sequence: Synthetic Chimeric Antigen Receptor sequence
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7110 - protein, 653 aa, Artificial Sequence
  Description of Artificial Sequence: Synthetic Chimeric Antigen Receptor sequence
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7111 - protein, 656 aa, Artificial Sequence
  Description of Artificial Sequence: Synthetic Chimeric Antigen Receptor sequence
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7112 - protein, 449 aa, Artificial Sequence; identical to SEQ ID NO: 7038
  Description of Artificial Sequence: Synthetic Chimeric Antigen Receptor sequence

SEQ ID NO: 7113 - protein, 452 aa, Artificial Sequence
  Description of Artificial Sequence: Synthetic Chimeric Antigen Receptor sequence
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7114 - protein, 478 aa, Artificial Sequence
  Description of Artificial Sequence: Synthetic Chimeric Antigen Receptor sequence
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7115 - protein, 481 aa, Artificial Sequence
  Description of Artificial Sequence: Synthetic Chimeric Antigen Receptor sequence
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7116 - protein, 664 aa, Artificial Sequence
  Description of Artificial Sequence: Synthetic Chimeric Antigen Receptor sequence
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7117 - protein, 667 aa, Artificial Sequence
  Description of Artificial Sequence: Synthetic Chimeric Antigen Receptor sequence
EVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7118 - protein, 470 aa, Artificial Sequence
  Description of Artificial Sequence: Synthetic Chimeric Antigen Receptor sequence
VQLQESGPGLVKPSQSLSLTCSVTDYSITSGYYWNWIRQFPGNKLEWMGYISYDGSNNYNPSLKNRISITRDTSKNQFFLKLSSVTTEDTATYYCSRGEGFYFDSWGQGTTLTVSSARSGGGGSGGGGSGGGGSDIMMSQSPSSLAVSVGEKFTMTCKSSQSLFFGSTQKNYLAWYQQKPGQSPKLLIYWASTRESGVPDRFTGSGSGTDFTLAISSVMPEDLAVYYCQQYYNYPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7119 - protein, 679 aa, Artificial Sequence
  Description of Artificial Sequence: Synthetic Chimeric Antigen Receptor sequence
MLLLVTSLLLCELPHPAFLLIPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7120 - protein, 672 aa, Artificial Sequence
  Description of Artificial Sequence: Synthetic Chimeric Antigen Receptor sequence
MLLLVTSLLLCELPHPAFLLIPQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7121 - protein, 679 aa, Artificial Sequence
  Description of Artificial Sequence: Synthetic Chimeric Antigen Receptor sequence
MLLLVTSLLLCELPHPAFLLIPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7122 - protein, 672 aa, Artificial Sequence
  Description of Artificial Sequence: Synthetic Chimeric Antigen Receptor sequence
MLLLVTSLLLCELPHPAFLLIPQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGGSGGGGSGGGGSDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7123 - protein, 520 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7124 - protein, 452 aa, Artificial Sequence; identical to SEQ ID NO: 7113
  Description of Artificial Sequence: Synthetic Chimeric Antigen Receptor sequence

SEQ ID NO: 7125 - protein, 478 aa, Artificial Sequence; identical to SEQ ID NO: 7114
  Description of Artificial Sequence: Synthetic Chimeric Antigen Receptor sequence

SEQ ID NO: 7126 - protein, 481 aa, Artificial Sequence; identical to SEQ ID NO: 7115
  Description of Artificial Sequence: Synthetic Chimeric Antigen Receptor sequence

SEQ ID NO: 7127 - protein, 664 aa, Artificial Sequence; identical to SEQ ID NO: 7116
  Description of Artificial Sequence: Synthetic Chimeric Antigen Receptor sequence

SEQ ID NO: 7128 - protein, 667 aa, Artificial Sequence; identical to SEQ ID NO: 7117
  Description of Artificial Sequence: Synthetic Chimeric Antigen Receptor sequence

SEQ ID NO: 7129 - protein, 487 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7130 - protein, 487 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7131 - protein, 487 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7132 - protein, 336 aa, Artificial Sequence
  Description of Artificial Sequence: Synthetic Chimeric Antigen Receptor sequence
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 7133 - protein, 486 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7134 - protein, 486 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7135 - protein, 486 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7136 - protein, 486 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7137 - protein, 486 aa, Artificial Sequence
  Description of Artificial Sequence: Synthetic Chimeric Antigen Receptor sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7138 - protein, 486 aa, Artificial Sequence
  Description of Artificial Sequence: Synthetic Chimeric Antigen Receptor sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7139 - protein, 486 aa, Artificial Sequence
  Description of Artificial Sequence: Synthetic Chimeric Antigen Receptor sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7140 - protein, 486 aa, Artificial Sequence
  Description of Artificial Sequence: Synthetic Chimeric Antigen Receptor sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7141 - protein, 486 aa, Artificial Sequence
  Description of Artificial Sequence: Synthetic Chimeric Antigen Receptor sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7142 - protein, 486 aa, Artificial Sequence
  Description of Artificial Sequence: Synthetic Chimeric Antigen Receptor sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7143 - protein, 486 aa, Artificial Sequence
  Description of Artificial Sequence: Synthetic Chimeric Antigen Receptor sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7144 - protein, 486 aa, Artificial Sequence
  Description of Artificial Sequence: Synthetic Chimeric Antigen Receptor sequence
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7145 - protein, 486 aa, Artificial Sequence
  Description of Artificial Sequence: Synthetic Chimeric Antigen Receptor sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7146 - protein, 486 aa, Artificial Sequence
  Description of Artificial Sequence: Synthetic Chimeric Antigen Receptor sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7147 - protein, 486 aa, Artificial Sequence
  Description of Artificial Sequence: Synthetic Chimeric Antigen Receptor sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7148 - protein, 486 aa, Artificial Sequence
  Description of Artificial Sequence: Synthetic Chimeric Antigen Receptor sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7149 - protein, 486 aa, Artificial Sequence
  Description of Artificial Sequence: Synthetic Chimeric Antigen Receptor sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7150 - protein, 486 aa, Artificial Sequence
  Description of Artificial Sequence: Synthetic Chimeric Antigen Receptor sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7151 - protein, 486 aa, Artificial Sequence
  Description of Artificial Sequence: Synthetic Chimeric Antigen Receptor sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7152 - protein, 486 aa, Artificial Sequence
  Description of Artificial Sequence: Synthetic Chimeric Antigen Receptor sequence
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7153 - protein, 486 aa, Artificial Sequence
  Description of Artificial Sequence: Synthetic Chimeric Antigen Receptor sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7154 - protein, 486 aa, Artificial Sequence
  Description of Artificial Sequence: Synthetic Chimeric Antigen Receptor sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7155 - protein, 486 aa, Artificial Sequence
  Description of Artificial Sequence: Synthetic Chimeric Antigen Receptor sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7156 - protein, 486 aa, Artificial Sequence
  Description of Artificial Sequence: Synthetic Chimeric Antigen Receptor sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7157 - protein, 486 aa, Artificial Sequence
  Description of Artificial Sequence: Synthetic Chimeric Antigen Receptor sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7158 - protein, 486 aa, Artificial Sequence
  Description of Artificial Sequence: Synthetic Chimeric Antigen Receptor sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7159 - protein, 486 aa, Artificial Sequence
  Description of Artificial Sequence: Synthetic Chimeric Antigen Receptor sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7160 - protein, 486 aa, Artificial Sequence
  Description of Artificial Sequence: Synthetic Chimeric Antigen Receptor sequence
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7161 - protein, 486 aa, Artificial Sequence
  Description of Artificial Sequence: Synthetic Chimeric Antigen Receptor sequence
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7162 - protein, 486 aa, Artificial Sequence
  Description of Artificial Sequence: Synthetic Chimeric Antigen Receptor sequence
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7163 - protein, 486 aa, Artificial Sequence
  Description of Artificial Sequence: Synthetic Chimeric Antigen Receptor sequence
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7164 - protein, 486 aa, Artificial Sequence
  Description of Artificial Sequence: Synthetic Chimeric Antigen Receptor sequence
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7165 - protein, 470 aa, Artificial Sequence
  Description of Artificial Sequence: Synthetic Chimeric Antigen Receptor sequence
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7166 - protein, 499 aa, Artificial Sequence
  Description of Artificial Sequence: Synthetic Chimeric Antigen Receptor sequence
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7167 - protein, 685 aa, Artificial Sequence
  Description of Artificial Sequence: Synthetic Chimeric Antigen Receptor sequence
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7168 - protein, 470 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7169 - protein, 470 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7170 - protein, 470 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7171 - protein, 470 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7172 - protein, 470 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7173 - protein, 470 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7174 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7175 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7176 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7177 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7178 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7179 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7180 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7181 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7182 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7183 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7184 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7185 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7186 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7187 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7188 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7189 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7190 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7191 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7192 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7193 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7194 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7195 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7196 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7197 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7198 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7199 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7200 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7201 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7202 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7203 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7204 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7205 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7206 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7207 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7208 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7209 - protein, 470 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7210 - protein, 499 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7211 - protein, 499 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7212 - protein, 499 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7213 - protein, 499 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7214 - protein, 499 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7215 - protein, 499 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7216 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7217 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7218 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7219 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7220 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7221 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7222 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7223 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7224 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7225 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7226 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7227 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7228 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7229 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7230 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7231 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7232 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7233 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7234 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7235 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7236 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7237 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7238 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7239 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7240 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7241 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7242 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7243 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7244 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7245 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7246 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7247 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7248 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7249 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7250 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7251 - protein, 499 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7252 - protein, 531 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7253 - protein, 531 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7254 - protein, 531 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7255 - protein, 531 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7256 - protein, 531 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7257 - protein, 531 aa, Artificial Sequence
  Description of Artificial Sequence: Synthetic Chimeric Antigen Receptor sequence
MALPVTALLLPLALLLHAARPEVKLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7258 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7259 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7260 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7261 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7262 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7263 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7264 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7265 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7266 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7267 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7268 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7269 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7270 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7271 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7272 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7273 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7274 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7275 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYSASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7276 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7277 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7278 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7279 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7280 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7281 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7282 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7283 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7284 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7285 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7286 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7287 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGLIRSKADGYTTEYAASVKGRFTISRDDSKSIAYLQMNSLKTEDTAVYYCARDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7288 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7289 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7290 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7291 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7292 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYRQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7293 - protein, 531 aa, Artificial Sequence
  Description of Artificial Sequence: Synthetic Chimeric Antigen Receptor sequence
MALPVTALLLPLALLLHAARPEVQLVESGGGLVQPGRSLRLSCTASGFTFTDYYMSWVRQAPGKGLEWVGFIRSKADGYTTEYAASVKGRFTISRDDSKSIAYLQMNSLKTEDTAVYYCTRDAAYYSYYSPEGAMDYWGQGTLVTVSSGGGGSGGGGSGGGGSMADYKDIQMTQSPSSVSASVGDRVTITCRASQNVDSAVAWYQQKPGKAPKLLIYSASYGQSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYC

SEQ ID NO: 7294 - protein, 526 aa, Artificial Sequence
  Description of Artificial Sequence: Synthetic Chimeric Antigen Receptor sequence
MALPVTALLLPLALLLHAARPEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSGGGGSGGGGSGGGGSMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGSGGGGSCPYSNPSLCSGGGGSCPYSNPSLCSGGGGSAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7295 - protein, 526 aa, Artificial Sequence; identical to SEQ ID NO: 7294
  Description of Artificial Sequence: Synthetic Chimeric Antigen Receptor sequence

SEQ ID NO: 7296 - protein, 473 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYWGQGTLVTVSSGGGGSGGGGSGGGGSDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7297 - protein, 473 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYWGQGTLVTVSSGGGGSGGGGSGGGGSDIQMTQSPSSVSASVGDRVTITCKASQNVDSAVAWYQQKPGKAPKLLIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7298 - protein, 470 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDLATYYCQQYYSTPTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7299 - protein, 470 aa, Artificial Sequence
  Description of Artificial Sequence: Synthetic Chimeric Antigen Receptor sequence
EVQLVESGGGLVQPGRSLRLSCTASGFTFTDYYMSVRQAPGKGLEWVGLIRSKADGYTTEYSASVKGRFTISRDDSKSILYLQMNSLKTEDTAVYYCARDAAYYSYYSPEGAMDYGQGTLVTVSSGGGGSGGGGSGGGGSDIQMTQSPSSVSASVGDRVTITCRASQNVDSAVAYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7300 - protein, 473 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7301 - protein, 471 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDFATYYCGQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7302 - protein, 473 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7303 - protein, 473 aa, Artificial Sequence; identical to SEQ ID NO: 7302
  Description of Artificial Sequence: Synthetic Chimeric Antigen Receptor sequence

SEQ ID NO: 7304 - protein, 657 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCKASQVDSAVAWYQQKPGKAPKLLIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7305 - protein, 657 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7306 - protein, 659 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYWGQGTLVTVSSGGGGSGGGGSGGGGSDIQMTQSPSSVSASVGDRVTITCRASQNVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7307 - protein, 657 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYGQGTLVTVSSGGGGSGGGGSGGGGSDIQMTQSPSSVSASVGDRVTITCRASQVDSAVAWYQQKPGKAPKALIYSASYRYSGVPSRFSGSGSGTDFTLTISSLQPEDFATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7308 - protein, 657 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYGQGTLVTVSSGGGGSGGGGSGGGGSDIQMTQSPSSVSASVGDRVTITCKASQVDSAVAWYQQKPGKAPKALIYSASYRYSGVPDRFSGSGSGTDFTLTISSLQPEDLATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7309 - protein, 659 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYAASVKGRFTISRDDSQSIAYLQMNSLKTEDTAVYYCARDAAYYSYYSPEGAMDYWGQGTLVTVSSGGGGSGGGGSGGGGSDIQMTQSPSSVSASVGDRVTITCKASQNVDSAVAWYQQKPGKAPKALIYSASYRYSGVPDRFSGSGSGTDFTLTISSLQPEDLATYYCQQYYSTPWTFGQGTKVEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7310 - protein, 657 aa, Artificial Sequence
  Description of Artificial Sequence: Synthetic Chimeric Antigen Receptor sequence
EVQLVESGGGLVQPGRSLRLSCTASGFTFTDYYMSWVRQAPGKGLEWVGLIRSKADGYTTEYSASVKGRFTISRDDSKSILYLQMNSLKTEDTAVYYCARDAAYYSYYSPEGAMDYWGQGTLVTVSSGGGGSGGGGSGGGGSDIVMTQSPSSVSASVGDRVTITCRASQNVDSAVAWYQQKPGKAPKALIYSASYRYSGVPSRFSGRGSGTDFTLTISSLQPEDFATYYCQQYYSTPWTFGQGTKVEIKREPKSPDKTHTCPPCPAPPVAGPSVFLFPPKPKDTLMIARTPEVTCWVDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7311 - protein, 511 aa, Artificial Sequence
  Description of Artificial Sequence: Synthetic Chimeric Antigen Receptor sequence
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7312 - protein, 517 aa, Artificial Sequence
  Description of Artificial Sequence: Synthetic Chimeric Antigen Receptor sequence
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7313 - protein, 526 aa, Artificial Sequence
  Description of Artificial Sequence: Synthetic Chimeric Antigen Receptor sequence
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCSGGGGSCPYSNPSLCAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7314 - protein, 532 aa, Artificial Sequence
  Description of Artificial Sequence: Synthetic Chimeric Antigen Receptor sequence
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPGSGGGGSCPYSNPSLCSGGGGSCPYSNPSLCSGGGGSAPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7315 - protein, 495 aa, Artificial Sequence
  Description of Artificial Sequence: Synthetic Chimeric Antigen Receptor sequence
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGCPYSNPSLCGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7316 - protein, 501 aa, Artificial Sequence
  Description of Artificial Sequence: Synthetic Chimeric Antigen Receptor sequence
MALPVTALLLPLALLLHAARPQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGGGCPYSNPSLCGGGGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7317 - protein, 508 aa, Artificial Sequence
  Description of Artificial Sequence: Synthetic Chimeric Antigen Receptor sequence
MALPVTALLLPLALLLHAARPGGGGSCPYSNPSLCGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7318 - protein, 514 aa, Artificial Sequence
  Description of Artificial Sequence: Synthetic Chimeric Antigen Receptor sequence
MALPVTALLLPLALLLHAARPGGGGSCPYSNPSLCSGGGGSGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7319 - protein, 523 aa, Artificial Sequence
  Description of Artificial Sequence: Synthetic Chimeric Antigen Receptor sequence
MALPVTALLLPLALLLHAARPGGGGSCPYSNPSLCSGGGGSCPYSNPSLCGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7320 - protein, 529 aa, Artificial Sequence
  Description of Artificial Sequence: Synthetic Chimeric Antigen Receptor sequence
MALPVTALLLPLALLLHAARPGGGGSCPYSNPSLCSGGGGSCPYSNPSLCSGGGGSGQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGGSGGGGSGGGGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKRSDPTTTPAPRPPTPAPTIASQPLSLRPEACRPAAGGAVHTRGLDFACDIYIWAPLAGTCGVLLLSLVITLYCRRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRE

SEQ ID NO: 7321 - protein, 511 aa, Artificial Sequence; identical to SEQ ID NO: 7311
  Description of Artificial Sequence: Synthetic Chimeric Antigen Receptor sequence

SEQ ID NO: 7322 - protein, 517 aa, Artificial Sequence; identical to SEQ ID NO: 7312
  Description of Artificial Sequence: Synthetic Chimeric Antigen Receptor sequence

SEQ ID NO: 7323 - protein, 526 aa, Artificial Sequence; identical to SEQ ID NO: 7313
  Description of Artificial Sequence: Synthetic Chimeric Antigen Receptor sequence

SEQ ID NO: 7324 - protein, 532 aa, Artificial Sequence; identical to SEQ ID NO: 7314
  Description of Artificial Sequence: Synthetic Chimeric Antigen Receptor sequence

SEQ ID NO: 7325 - protein, 495 aa, Artificial Sequence; identical to SEQ ID NO: 7315
  Description of Artificial Sequence: Synthetic Chimeric Antigen Receptor sequence

SEQ ID NO: 7326 - protein, 501 aa, Artificial Sequence; identical to SEQ ID NO: 7316
  Description of Artificial Sequence: Synthetic Chimeric Antigen Receptor sequence

SEQ ID NO: 7327 - protein, 508 aa, Artificial Sequence; identical to SEQ ID NO: 7317
  Description of Artificial Sequence: Synthetic Chimeric Antigen Receptor sequence

SEQ ID NO: 7328 - protein, 514 aa, Artificial Sequence; identical to SEQ ID NO: 7318
  Description of Artificial Sequence: Synthetic Chimeric Antigen Receptor sequence

SEQ ID NO: 7329 - protein, 523 aa, Artificial Sequence; identical to SEQ ID NO: 7319
  Description of Artificial Sequence: Synthetic Chimeric Antigen Receptor sequence

SEQ ID NO: 7330 - protein, 529 aa, Artificial Sequence; identical to SEQ ID NO: 7320
  Description of Artificial Sequence: Synthetic Chimeric Antigen Receptor sequence

SEQ ID NO: 7331 - protein, 467 aa, Artificial Sequence; identical to SEQ ID NO: 7108
  Description of Artificial Sequence: Synthetic Chimeric Antigen Receptor sequence

SEQ ID NO: 7332 - protein, 486 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7333 - protein, 486 aa, Artificial Sequence
  Description of Artificial Sequence: Synthetic Chimeric Antigen Receptor sequence
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7334 - protein, 680 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7335 - protein, 680 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFLGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7336 - protein, 680 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7337 - protein, 580 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7338 - protein, 711 aa, Artificial Sequence
  Description of Artificial Sequence: Synthetic Chimeric Antigen Receptor sequence
MLLLVTSLLLLCELPHPAFLLIPDIQMTQQTTSSLSASLGDRVTISCRASSQDISKYLNWYQQKPDGTVKLLLIYHTSRLHSGVPSRFSGSGGSGTDYSLTISNLEQEDIATYYFCQQGNTLPYTFGGGTKLEIITGSTSGSGKPGSGEGSTKGEEVKLQESGPGLVAPSQSLSVTTCTVSGVSLPDYGVSWIRQPPPRKGLEWLGVIWGSETTYYNSSALKSRLTIIKDNSKSQVFLKKMNSLQTDDTAIYYCAKHYYYYGGSYAMDYWGQGTSVTVSSEESKYGPPCPPCPAPEFLGGPSSVFLFPPKPKDTLMISRTPEVVTCVVVDVSQEDPEVQFNWYVVDGVEVHNAKTKPREEQFNSTTYRVVSVLTVLHQDWLNGKEYYKCKVSNKGLPSSIEKTISKAAKGQPREPQVYTLPPSQEEMTTKNQVSLTCLVKGFYPSDIAVVEWESNGQPENNYKTTPPVLDDSDGSFFLYSRLTVDKSRWQEEGNVFSCSVMHEALHNHYTQKKSLSLSLGKMFWVLVVVGGVLLACYSLLVTVAFIIFWVRSKRRSRGGHSDYMNMTPRRPGPTRRKHYQPYAPPRDFAAYRSRVKKFSRSADAPAYQQGQNQLYNEELNLGRREEYDVLDKRRGRDPPEMGGKPRRKNPQEGLYNELQQKDKMAEAYSEIGMKGERRRGGKGHDGLYQGLSTATKDTYDAALHMQALPPR

SEQ ID NO: 7339 - protein, 495 aa, Artificial Sequence
  Description of Artificial Sequence: Synthetic Chimeric Antigen Receptor sequence
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRADTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7340 - protein, 495 aa, Artificial Sequence; identical to SEQ ID NO: 5754
  Description of Artificial Sequence: Synthetic Chimeric Antigen Receptor sequence

SEQ ID NO: 7341 - protein, 484 aa, Artificial Sequence
  Description of Artificial Sequence: Synthetic Chimeric Antigen Receptor sequence
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDMWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7342 - protein, 476 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCG

SEQ ID NO: 7343 - protein, 248 aa, Artificial Sequence
  Description of Artificial Sequence: Synthetic Chimeric Antigen Receptor sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVS

SEQ ID NO: 7344 - protein, 254 aa, Artificial Sequence
  Description of Artificial Sequence: Synthetic Chimeric Antigen Receptor sequence
RCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSM

SEQ ID NO: 7345 - protein, 489 aa, Artificial Sequence
  Description of Artificial Sequence: Synthetic Chimeric Antigen Receptor sequence
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRTTTPAPRPPTPAPTIASQPLSLRPEACRPAAGGAVHTRGLDFACDIYIWAPLAGTCGVLLLSLVITLYCAVSLSKMLKKRSPLTTGVYVKMPPTEPECEKQFQPYFIPINSARVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7346 - protein, 522 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKIRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 7347 - protein, 508 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCALYLLRRDQRLPPDAHKPPGGGSFRTPIQEEQADAHSTLAKIRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 7348 - protein, 528 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCQRRKYRSNKGESPVEPAEPCHYSCPREEEGSTIPIQEDYRKPEPACSPRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 7349 - protein, 514 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCQRRKYRSNKGESPVEPAEPCHYSCPREEEGSTIPIQEDYRKPEPACSPRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 7350 - protein, 522 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRSKRSRLLHSDYMNMTPRRPGPTRKHYQPYAPPRDFAAYRSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 7351 - protein, 508 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRSKRSRLLHSDYMNMTPRRPGPTRKHYQPYAPPRDFAAYRSILWHEMWHEGLIEASRLYFGERNVKGMFEVLEPLHAMMERGPQTLKETSFNQAYGRDLMEAQEWCRKYMKSGNVKDLLQAWDLYYHVFRRISK

SEQ ID NO: 7352 - protein, 495 aa, Artificial Sequence; identical to SEQ ID NO: 5754
  Description of Artificial Sequence: Synthetic Chimeric Antigen Receptor sequence

SEQ ID NO: 7353 - protein, 495 aa, Artificial Sequence; identical to SEQ ID NO: 5754
  Description of Artificial Sequence: Synthetic Chimeric Antigen Receptor sequence

SEQ ID NO: 7354 - protein, 495 aa, Artificial Sequence; identical to SEQ ID NO: 5754
  Description of Artificial Sequence: Synthetic Chimeric Antigen Receptor sequence

SEQ ID NO: 7355 - protein, 495 aa, Artificial Sequence; identical to SEQ ID NO: 5754
  Description of Artificial Sequence: Synthetic Chimeric Antigen Receptor sequence

SEQ ID NO: 7356 - protein, 495 aa, Artificial Sequence; identical to SEQ ID NO: 5754
  Description of Artificial Sequence: Synthetic Chimeric Antigen Receptor sequence

SEQ ID NO: 7357 - protein, 495 aa, Artificial Sequence; identical to SEQ ID NO: 5754
  Description of Artificial Sequence: Synthetic Chimeric Antigen Receptor sequence

SEQ ID NO: 7358 - protein, 495 aa, Artificial Sequence; identical to SEQ ID NO: 5754
  Description of Artificial Sequence: Synthetic Chimeric Antigen Receptor sequence

SEQ ID NO: 7359 - protein, 495 aa, Artificial Sequence; identical to SEQ ID NO: 5754
  Description of Artificial Sequence: Synthetic Chimeric Antigen Receptor sequence

SEQ ID NO: 7360 - protein, 251 aa, Artificial Sequence; identical to SEQ ID NO: 5833
  Description of Artificial Sequence: Synthetic Chimeric Antigen Receptor sequence

SEQ ID NO: 7361 - protein, 495 aa, Artificial Sequence; identical to SEQ ID NO: 5754
  Description of Artificial Sequence: Synthetic Chimeric Antigen Receptor sequence

SEQ ID NO: 7362 - protein, 495 aa, Artificial Sequence; identical to SEQ ID NO: 5754
  Description of Artificial Sequence: Synthetic Chimeric Antigen Receptor sequence

SEQ ID NO: 7363 - protein, 495 aa, Artificial Sequence; identical to SEQ ID NO: 5754
  Description of Artificial Sequence: Synthetic Chimeric Antigen Receptor sequence

SEQ ID NO: 7364 - protein, 495 aa, Artificial Sequence; identical to SEQ ID NO: 7339
  Description of Artificial Sequence: Synthetic Chimeric Antigen Receptor sequence

SEQ ID NO: 7365 - protein, 495 aa, Artificial Sequence; identical to SEQ ID NO: 5754
  Description of Artificial Sequence: Synthetic Chimeric Antigen Receptor sequence

SEQ ID NO: 7366 - protein, 495 aa, Artificial Sequence; identical to SEQ ID NO: 7339
  Description of Artificial Sequence: Synthetic Chimeric Antigen Receptor sequence

SEQ ID NO: 7367 - protein, 495 aa, Artificial Sequence; identical to SEQ ID NO: 5754
  Description of Artificial Sequence: Synthetic Chimeric Antigen Receptor sequence

SEQ ID NO: 7368 - protein, 495 aa, Artificial Sequence; identical to SEQ ID NO: 7339
  Description of Artificial Sequence: Synthetic Chimeric Antigen Receptor sequence

SEQ ID NO: 7369 - protein, 495 aa, Artificial Sequence; identical to SEQ ID NO: 5754
  Description of Artificial Sequence: Synthetic Chimeric Antigen Receptor sequence

SEQ ID NO: 7370 - protein, 494 aa, Artificial Sequence
  Description of Artificial Sequence: Synthetic Chimeric Antigen Receptor sequence
METDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7371 - protein, 494 aa, Artificial Sequence; identical to SEQ ID NO: 7370
  Description of Artificial Sequence: Synthetic Chimeric Antigen Receptor sequence

SEQ ID NO: 7372 - protein, 144 aa, Artificial Sequence
  Description of Artificial Sequence: Synthetic Chimeric Antigen Receptor sequence
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSE

SEQ ID NO: 7373 - protein, 486 aa, Artificial Sequence; identical to SEQ ID NO: 7332
  Description of Artificial Sequence: Synthetic Chimeric Antigen Receptor sequence

SEQ ID NO: 7374 - protein, 486 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7375 - protein, 486 aa, Artificial Sequence
  Description of Artificial Sequence: Synthetic Chimeric Antigen Receptor sequence
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7376 - protein, 486 aa, Artificial Sequence
  Description of Artificial Sequence: Synthetic Chimeric Antigen Receptor sequence
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7377 - protein, 491 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7378 - protein, 491 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7379 - protein, 491 aa, Artificial Sequence
  Description of Artificial Sequence: Synthetic Chimeric Antigen Receptor sequence
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7380 - protein, 491 aa, Artificial Sequence
  Description of Artificial Sequence: Synthetic Chimeric Antigen Receptor sequence
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7381 - protein, 491 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7382 - protein, 491 aa, Artificial Sequence; identical to SEQ ID NO: 7381
  Description of Artificial Sequence: Synthetic Chimeric Antigen Receptor sequence

SEQ ID NO: 7383 - protein, 491 aa, Artificial Sequence
  Description of Artificial Sequence: Synthetic Chimeric Antigen Receptor sequence
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7384 - protein, 486 aa, Artificial Sequence
  Description of Artificial Sequence: Synthetic Chimeric Antigen Receptor sequence
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7385 - protein, 486 aa, Artificial Sequence; identical to SEQ ID NO: 7333
  Description of Artificial Sequence: Synthetic Chimeric Antigen Receptor sequence

SEQ ID NO: 7386 - protein, 495 aa, Artificial Sequence; identical to SEQ ID NO: 7339
  Description of Artificial Sequence: Synthetic Chimeric Antigen Receptor sequence

SEQ ID NO: 7387 - protein, 495 aa, Artificial Sequence; identical to SEQ ID NO: 5754
  Description of Artificial Sequence: Synthetic Chimeric Antigen Receptor sequence

SEQ ID NO: 7388 - protein, 530 aa, Artificial Sequence
  Description of Artificial Sequence: Synthetic Chimeric Antigen Receptor sequence
MALPVTALLLPLALLLHAARPDIMMTQSPSSLAVSAGEKVTMTCKSSQSVLYSSNQKNYLAWYQQKPGQSPKLLIYWASTRESGVPDRFTGSGSGTDFTLTISSVQPEDLAVYYCHQYLSSHTFGGGTKLEIKRGGGGSGGGGSGGGGSQLQQPGAELVRPGSSVKLSCKASGYTFTRYWIHWVKQRPIQGLEWIGNIDPSDSETHYNQKFKDKATLTVDKSSGTAYMQLSSLTSEDSAVYYCATEDLYYAMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7389 - protein, 486 aa, Artificial Sequence; identical to SEQ ID NO: 7374
  Description of Artificial Sequence: Synthetic Chimeric Antigen Receptor sequence

SEQ ID NO: 7390 - protein, 486 aa, Artificial Sequence; identical to SEQ ID NO: 7375
  Description of Artificial Sequence: Synthetic Chimeric Antigen Receptor sequence

SEQ ID NO: 7391 - protein, 486 aa, Artificial Sequence; identical to SEQ ID NO: 7376
  Description of Artificial Sequence: Synthetic Chimeric Antigen Receptor sequence

SEQ ID NO: 7392 - protein, 491 aa, Artificial Sequence; identical to SEQ ID NO: 7377
  Description of Artificial Sequence: Synthetic Chimeric Antigen Receptor sequence

SEQ ID NO: 7393 - protein, 491 aa, Artificial Sequence; identical to SEQ ID NO: 7378
  Description of Artificial Sequence: Synthetic Chimeric Antigen Receptor sequence

SEQ ID NO: 7394 - protein, 491 aa, Artificial Sequence; identical to SEQ ID NO: 7379
  Description of Artificial Sequence: Synthetic Chimeric Antigen Receptor sequence

SEQ ID NO: 7395 - protein, 491 aa, Artificial Sequence; identical to SEQ ID NO: 7380
  Description of Artificial Sequence: Synthetic Chimeric Antigen Receptor sequence

SEQ ID NO: 7396 - protein, 491 aa, Artificial Sequence; identical to SEQ ID NO: 7381
  Description of Artificial Sequence: Synthetic Chimeric Antigen Receptor sequence

SEQ ID NO: 7397 - protein, 491 aa, Artificial Sequence; identical to SEQ ID NO: 7381
  Description of Artificial Sequence: Synthetic Chimeric Antigen Receptor sequence

SEQ ID NO: 7398 - protein, 491 aa, Artificial Sequence; identical to SEQ ID NO: 7383
  Description of Artificial Sequence: Synthetic Chimeric Antigen Receptor sequence

SEQ ID NO: 7399 - protein, 486 aa, Artificial Sequence; identical to SEQ ID NO: 7384
  Description of Artificial Sequence: Synthetic Chimeric Antigen Receptor sequence

SEQ ID NO: 7400 - protein, 465 aa, Artificial Sequence
  Description of Artificial Sequence: Synthetic Chimeric Antigen Receptor sequence
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7401 - protein, 681 aa, Artificial Sequence
  Description of Artificial Sequence: Synthetic Chimeric Antigen Receptor sequence
MGTSLLCWMALCLLGADHADAQVQLQQSGPELVKPGASVKISCKASGYAFSSSWMNWVKQRPGKGLEWIGRIYPGDEDTNYSGKFKDKATLTADKSSTTAYMQLSSLTSEDSAVYFCARSLLYGDYLDYWGQGTTLTVSSGGGGSGGGGSGGGGSQIVLTQSPAIMSASPGEKVTMTCSASSSVSYMHWYQQKSGTSPKRWIYDTSKLASGVPDRFSGSGSGTSYFLTINNMEAEDAATYYCQQWNINPLTFGAGTKLELKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7402 - protein, 838 aa, Artificial Sequence
  Description of Artificial Sequence: Synthetic Chimeric Antigen Receptor sequence
MLLLVTSLLLCELPHPAFLLIPQSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYGDFNIWGPGTLVTISSGGGGSGGGGSGGGGSELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVKESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 7403 - protein, 1055 aa, Artificial Sequence [sequence omitted]

SEQ ID NO: 7404 - protein, 945 aa, Artificial Sequence
  Description of Artificial Sequence: Synthetic Chimeric Antigen Receptor sequence
MLLLVTSLLLCELPHPAFLLIPQSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYGDFNIWGPGTLVTISSGGGGSGGGGSGGGGSELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVKESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 7405 - protein, 845 aa, Artificial Sequence
  Description of Artificial Sequence: Synthetic Chimeric Antigen Receptor sequence
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 7406 - protein, 952 aa, Artificial Sequence
  Description of Artificial Sequence: Synthetic Chimeric Antigen Receptor sequence
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 7407 - protein, 1062 aa, Artificial Sequence
  Description of Artificial Sequence: Synthetic Chimeric Antigen Receptor sequence
MLLLVTSLLLCELPHPAFLLIPQEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISSGGGGSGGGGSGGGGSELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTGESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 7408 - protein, 502 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7409 - protein, 508 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7410 - protein, 509 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7411 - protein, 550 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7412 - protein, 556 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7413 - protein, 506 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7414 - protein, 560 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7415 - protein, 513 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7416 - protein, 554 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7417 - protein, 476 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPQVRKAAITSYEKSDGVYTGLSTRNQETYETLKHEKPPQ

SEQ ID NO: 7418 - protein, 480 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQRRKYRSNKGESPVEPAEPCRYSCPREEEGSTIPIQEDYRKPEPACSPQVRKAAITSYEKSDGVYTGLSTRNQETYETLKHEKPPQ

SEQ ID NO: 7419 - protein, 428 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSRFTFGPGTKVDIKGSTSGSGKPGSGEGSTKGQVQLVQSGAEVKKPGSSVKVSCKDSGGTFSSYAISWVRQAPGQGLEWMGGIIPIFGTTNYAQQFQGRVTITADESTSTAYMELSSLRSEDTAVYYCAREAVAADWLDPWGQGTLVTVSSFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQVRKAAITSYEKSDGVYTGLSTRNQETYETLKHEKPPQ

SEQ ID NO: 7420 - protein, 432 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSQVRKAAITSYEKSDGVYTGLSTRNQETYETLKHEKPPQ

SEQ ID NO: 7421 - protein, 486 aa, Artificial Sequence; identical to SEQ ID NO: 7332
  Description of Artificial Sequence: Synthetic Chimeric Antigen Receptor sequence

SEQ ID NO: 7422 - protein, 486 aa, Artificial Sequence; identical to SEQ ID NO: 7374
  Description of Artificial Sequence: Synthetic Chimeric Antigen Receptor sequence

SEQ ID NO: 7423 - protein, 486 aa, Artificial Sequence; identical to SEQ ID NO: 7375
  Description of Artificial Sequence: Synthetic Chimeric Antigen Receptor sequence

SEQ ID NO: 7424 - protein, 486 aa, Artificial Sequence; identical to SEQ ID NO: 7376
  Description of Artificial Sequence: Synthetic Chimeric Antigen Receptor sequence

SEQ ID NO: 7425 - protein, 491 aa, Artificial Sequence; identical to SEQ ID NO: 7377
  Description of Artificial Sequence: Synthetic Chimeric Antigen Receptor sequence

SEQ ID NO: 7426 - protein, 491 aa, Artificial Sequence; identical to SEQ ID NO: 7378
  Description of Artificial Sequence: Synthetic Chimeric Antigen Receptor sequence

SEQ ID NO: 7427 - protein, 491 aa, Artificial Sequence; identical to SEQ ID NO: 7379
  Description of Artificial Sequence: Synthetic Chimeric Antigen Receptor sequence

SEQ ID NO: 7428 - protein, 491 aa, Artificial Sequence; identical to SEQ ID NO: 7380
  Description of Artificial Sequence: Synthetic Chimeric Antigen Receptor sequence

SEQ ID NO: 7429 - protein, 491 aa, Artificial Sequence; identical to SEQ ID NO: 7381
  Description of Artificial Sequence: Synthetic Chimeric Antigen Receptor sequence

SEQ ID NO: 7430 - protein, 491 aa, Artificial Sequence; identical to SEQ ID NO: 7381
  Description of Artificial Sequence: Synthetic Chimeric Antigen Receptor sequence

SEQ ID NO: 7431 - protein, 491 aa, Artificial Sequence; identical to SEQ ID NO: 7383
  Description of Artificial Sequence: Synthetic Chimeric Antigen Receptor sequence

SEQ ID NO: 7432 - protein, 486 aa, Artificial Sequence; identical to SEQ ID NO: 7384
  Description of Artificial Sequence: Synthetic Chimeric Antigen Receptor sequence

SEQ ID NO: 7433 - protein, 486 aa, Artificial Sequence; identical to SEQ ID NO: 7333
  Description of Artificial Sequence: Synthetic Chimeric Antigen Receptor sequence

SEQ ID NO: 7434 - protein, 486 aa, Artificial Sequence; identical to SEQ ID NO: 7332
  Description of Artificial Sequence: Synthetic Chimeric Antigen Receptor sequence

SEQ ID NO: 7435 - protein, 486 aa, Artificial Sequence; identical to SEQ ID NO: 7374
  Description of Artificial Sequence: Synthetic Chimeric Antigen Receptor sequence

SEQ ID NO: 7436 - protein, 486 aa, Artificial Sequence; identical to SEQ ID NO: 7375
  Description of Artificial Sequence: Synthetic Chimeric Antigen Receptor sequence

SEQ ID NO: 7437 - protein, 486 aa, Artificial Sequence; identical to SEQ ID NO: 7376
  Description of Artificial Sequence: Synthetic Chimeric Antigen Receptor sequence

SEQ ID NO: 7438 - protein, 491 aa, Artificial Sequence; identical to SEQ ID NO: 7377
  Description of Artificial Sequence: Synthetic Chimeric Antigen Receptor sequence

SEQ ID NO: 7439 - protein, 491 aa, Artificial Sequence; identical to SEQ ID NO: 7378
  Description of Artificial Sequence: Synthetic Chimeric Antigen Receptor sequence

SEQ ID NO: 7440 - protein, 491 aa, Artificial Sequence; identical to SEQ ID NO: 7379
  Description of Artificial Sequence: Synthetic Chimeric Antigen Receptor sequence

SEQ ID NO: 7441 - protein, 491 aa, Artificial Sequence; identical to SEQ ID NO: 7380
  Description of Artificial Sequence: Synthetic Chimeric Antigen Receptor sequence

SEQ ID NO: 7442 - protein, 491 aa, Artificial Sequence; identical to SEQ ID NO: 7381
  Description of Artificial Sequence: Synthetic Chimeric Antigen Receptor sequence

SEQ ID NO: 7443 - protein, 491 aa, Artificial Sequence; identical to SEQ ID NO: 7381
  Description of Artificial Sequence: Synthetic Chimeric Antigen Receptor sequence

SEQ ID NO: 7444 - protein, 491 aa, Artificial Sequence; identical to SEQ ID NO: 7383
  Description of Artificial Sequence: Synthetic Chimeric Antigen Receptor sequence

SEQ ID NO: 7445 - protein, 486 aa, Artificial Sequence; identical to SEQ ID NO: 7384
  Description of Artificial Sequence: Synthetic Chimeric Antigen Receptor sequence

SEQ ID NO: 7446 - protein, 527 aa, Artificial Sequence
  Description of Artificial Sequence: Synthetic Chimeric Antigen Receptor sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVRWGSETTYYNSALKSRLTIIKDNSKSQVFLKMNSLQTDDTAIYYCAKHYYYGGSYAMDYWGQGTSVTVSSAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSASGGGGSGGGGSKSRQTPPLASVEMEAMEALPVTWGTSSRDEDLENCSHHLGGGGSGGGGSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7447 - protein, 737 aa, Artificial Sequence
  Description of Artificial Sequence: Synthetic Chimeric Antigen Receptor sequence
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7448 - protein, 527 aa, Artificial Sequence; identical to SEQ ID NO: 7092
  Description of Artificial Sequence: Synthetic Chimeric Antigen Receptor sequence

SEQ ID NO: 7449 - protein, 424 aa, Artificial Sequence; identical to SEQ ID NO: 6984
  Description of Artificial Sequence: Synthetic Chimeric Antigen Receptor sequence

SEQ ID NO: 7450 - protein, 1090 aa, Artificial Sequence
  Description of Artificial Sequence: Synthetic Chimeric Antigen Receptor sequence
MLLLVTSLLLCELPHPAFLLIPMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKESKYGPPCPPCPMFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 7451 - protein, 970 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7452 - protein, 1133 aa, Artificial Sequence
  Description of Artificial Sequence: Synthetic Chimeric Antigen Receptor sequence
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKESKYGPPCPPCPKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 7453 - protein, 727 aa, Artificial Sequence
  Description of Artificial Sequence: Synthetic Chimeric Antigen Receptor sequence
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7454 - protein, 529 aa, Artificial Sequence
  Description of Artificial Sequence: Synthetic Chimeric Antigen Receptor sequence
MALPVTALLLPLALLLHAARPDIVMTQSPATLSVTPGDRVSLSCRASQSISDYLHWYQQKSHESPRLLIKYASQSISGIPSRFSGSGSGSDFTLSINSVEPEDVGVYYCQNGHSFPLTFGAGTKLELRRGGGGSGGGGSGGGGSQVQLQQPGTELVRPGSSVKLSCKASGYTFTSYWVNWVKQRPDQGLEWIGRIDPYDSETHYNQKFTDKAISTIDTSSNTAYMQLSTLTSDASAVYYCSRSPRDSSTNLADWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7455 - protein, 266 aa, Artificial Sequence
  Description of Artificial Sequence: Synthetic Chimeric Antigen Receptor sequence
METDTLLLWVLLLWVPGSTGDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKGSTSGGGSGGGSGGGGSSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 7456 - protein, 389 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAIELLPVPGAKKSAKLYIPYIILTIIILTIVGFIWLLKVNGCRKYKLNKTESTPVVEEDEMQPYASYTEKNNPLYDTTNKVKASEALQSEVDTDLHTLSHG

SEQ ID NO: 7457 - protein, 428 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQSHG

SEQ ID NO: 7458 - protein, 389 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVQAPSSSPMGIIVAVVTGIAVAAIVAAVVALIYCRKKRISALPGYPECREMGETLPEKPANPTNPDEADKVGAENTITYSLLMHPDALEEPDDQNRISHG

SEQ ID NO: 7459 - protein, 430 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAMSHG

SEQ ID NO: 7460 - protein, 413 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKSSHG

SEQ ID NO: 7461 - protein, 463 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGTSRNRTGLTAAGITGLVLSILVLAAAAALLHYARARRKPGGLSATGTSSHSPSECQEPSSSRPSRIDPQEPTHSKPLAPMELEPMYSNANPGDSNPIYSQIWSIQHTKENSANCPMMHQEHEELTVLYSELKKTHPDDSAGEASSRGRAHEEDDEENYENVPRVLLASDHSHG

SEQ ID NO: 7462 - protein, 433 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEESSHG

SEQ ID NO: 7463 - protein, 435 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHRSHG

SEQ ID NO: 7464 - protein, 435 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCPSHG

SEQ ID NO: 7465 - protein, 428 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEPSHG

SEQ ID NO: 7466 - protein, 467 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSDASDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGISHG

SEQ ID NO: 7467 - protein, 467 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGISHG

SEQ ID NO: 7468 - protein, 436 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCPSHG

SEQ ID NO: 7469 - protein, 447 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVFSHG

SEQ ID NO: 7470 - protein, 407 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSASFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSVSHG

SEQ ID NO: 7471 - protein, 471 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIHSHG

SEQ ID NO: 7472 - protein, 504 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIHSHG

SEQ ID NO: 7473 - protein, 522 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIHSHG

SEQ ID NO: 7474 - protein, 464 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIHSHG

SEQ ID NO: 7475 - protein, 422 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNFSHG

SEQ ID NO: 7476 - protein, 415 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKNSHG

SEQ ID NO: 7477 - protein, 434 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSH

SEQ ID NO: 7478 - protein, 439 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGTSHG

SEQ ID NO: 7479 - protein, 445 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPKAPPSHRPLKSPQNETLYSVLKASHG

SEQ ID NO: 7480 - protein, 381 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVKEGPPSEHSGISRNAIIFLVLGILVFLILLGIGIYFYWSKCSREVLWHCHLCPSSTEHASASANGHVSYSAVSRENSSSQDPQTEGTRSHG

SEQ ID NO: 7481 - protein, 548 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQSHG

SEQ ID NO: 7482 - protein, 538 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPKSHG

SEQ ID NO: 7483 - protein, 425 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPKSHG

SEQ ID NO: 7484 - protein, 513 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVYSLPQLLGPSCSWEAEGLHCRCSFRAWPAPSLCWRLEEKPLEGNSSQGSFKVNSSSPGPWANSSLILHGGLNSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSKSHG

SEQ ID NO: 7485 - protein, 412 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHKSHG

SEQ ID NO: 7486 - protein, 423 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPKSHG

SEQ ID NO: 7487 - protein, 447 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRGSHG

SEQ ID NO: 7488 - protein, 419 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSALQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHRSHG

SEQ ID NO: 7489 - protein, 531 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHG

SEQ ID NO: 7490 - protein, 554 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHG

SEQ ID NO: 7491 - protein, 498 aa, Artificial Sequence
  Description of Artificial Sequence: Synthetic Chimeric Antigen Receptor sequence
MALPVTALLLPLALLLHAARPGSGSGAQAAEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHG

SEQ ID NO: 7492 - protein, 496 aa, Artificial Sequence
  Description of Artificial Sequence: Synthetic Chimeric Antigen Receptor sequence
MALPVTALLLPLALLLHAARPEVQLVESGAEVKKPGASVKVSCKASGYTFTGYYMHWVRQAPGQGLEWMGWINPNSGGTNYAQKFQGRVTMTRDTSISTAYMELSRLRSDDTAVYYCAREPASSSWYGYYYYMDVWGKGTLVTVSSGGGGSGGGGSGGGGSGGGGSDIQMTQSPSSLSASVGDRVTITCRASQSINTYLNWYQQKPGKPPKLLIYAASNLQSGVPSRFSGSGSGTHFTLTISSLQPDDFATYYCQQSYSSLLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7493 - protein, 495 aa, Artificial Sequence
  Description of Artificial Sequence: Synthetic Chimeric Antigen Receptor sequence
MALPVTALLLPLALLLHAARPQVQLVQSGGGLIQPGGSLRLSCAASGFTVSSNYMSWVRQAPGKGLEWVSVIYSGGSTYYADSVKGRFTISRDNSKNTLYLQMNSLRAEDTAVYYCASQSTPYDSSGYYSGDAFDIWGQGTMVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7494 - protein, 498 aa, Artificial Sequence
  Description of Artificial Sequence: Synthetic Chimeric Antigen Receptor sequence
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7495 - protein, 493 aa, Artificial Sequence
  Description of Artificial Sequence: Synthetic Chimeric Antigen Receptor sequence
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREESSSGWYEGNWFDPWGQGTLVTVSSGGGGSGGGGSGGGGSSSELTQDPAVSVALGQTVRITCQGDSLRSYYASWYQQKPGQAPVLVIYGKNHRPSGIPDRFSGSSSGDTDSLTITGAQAEDEADYYCHSRDSSGNHLFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7496 - protein, 497 aa, Artificial Sequence
  Description of Artificial Sequence: Synthetic Chimeric Antigen Receptor sequence
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7497 - protein, 489 aa, Artificial Sequence
  Description of Artificial Sequence: Synthetic Chimeric Antigen Receptor sequence
MALPVTALLLPLALLLHAARPQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGRMDTAMAQIWGQGTMVTVSSGDGGSGGGGSGGGGSNFMLTQPHSVSESPGKTVTIPCTGSSGSFASSYVQWYQQRPGSAPATVIYEDNQRPSGVPDRFSGSVDSSSNSASLTISGLKTEDEAVYYCQSYDGATWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7498 - protein, 486 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLDVSLDIWGQGTMVTVSSGGGGSGGGGSGGGGSQSALTQPASVSGSPGQSITISCSGTSSDVGGYNSVSWYQQYPGKAPKLMIYDVNNRPSGVSSRFSGSKSGNTASLTISGLQAEDEADYYCSSYTSSSTLFFGAGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7499 - protein, 491 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMHWVRQAPGKGLEYVSAISSNGGSTYYANSVKDRFTISRDNSKNTLYLQMGSLRAEDMAVYYCARVHSSGYYHPGPNDYWGQGTLVTVSSGGGGSGGGGSGGGGSSSELTQDPAVSVALGQTVRITCQGDSLRTYYATWYQQKPGQAPVLVFYDENNRPSGIPDRFSGSSSGNTASLTITGTQAEDEADYYCSSRDSSGNPSCVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7500 - protein, 487 aa, Artificial Sequence
  Description of Artificial Sequence: Synthetic Chimeric Antigen Receptor sequence
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTAYMELSSLRSEDTAVYYCAREAGVVAVDYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7501 - protein, 494 aa, Artificial Sequence
  Description of Artificial Sequence: Synthetic Chimeric Antigen Receptor sequence
MALPVTALLLPLALLLHAARPQVQLVQSGGGVVQPGRSLRLSCAASGFTFSSYAMSWVRQAPGKGLEWVSAISGSGGSTYYADSVKGRFTISRDNSKNTLYLQMNSLRAEDTAVYYCAKEPLFGVVEEDVDYWGQGTLVTVSSGGGGSGGGGSGGGGSDVVMTQSPLSLPVTPGEPASISCRSSQSLLAGNGHNYLDWYLQKPGQSPQLLIYLGSNRASGVPDRFSGSGSGTDFTLKISRVEAEDVGVYYCMQALQNPLTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7502 - protein, 489 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSGSLGDAFDIWGQGTMVTVSSGGGGSGGGGSGGGGSQSALTQPASVSGSPGQSITISCTGSSSDVGGYNYVSWYQQHPGKAPKLMIYEVSNRPSGVSNRFSGSKSGNTASLTISGLQAEDEADYYCSSYTSSSTLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7503 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGFGELSGAFDIWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYASSSTLVFGGGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7504 - protein, 495 aa, Artificial Sequence
  Description of Artificial Sequence: Synthetic Chimeric Antigen Receptor sequence
MALPVTALLLPLALLLHAARPEVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7505 - protein, 491 aa, Artificial Sequence
  Description of Artificial Sequence: Synthetic Chimeric Antigen Receptor sequence
MALPVTALLLPLALLLHAARPEVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPIGCSGGSCLDYWGQGTLVTVSSGGGGSGGGGSGGGGSQSALTQPAYVSGSPGQSITISCTGTNSDVGRYNYVSWYQQHPGKAPKLMIYEVSYRPSGVSNRFSGSKSGNTASLTISGLQAEDEADYYCSSYTTSSTLDFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7506 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGSYGDYGDAFDIWGQGTTVTVSSGGGGSGGGGSGSGGSQSALTQPASVSGSPGQSITISCTGTSSDVGGYKYVSWYQQHPGKAPKLMIYDVSNRPSGVSNRFSGSKSGNTASLTISGLQAEDEADYYCSSYTSSSTLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7507 - protein, 488 aa, Artificial Sequence
  Description of Artificial Sequence: Synthetic Chimeric Antigen Receptor sequence
MALPVTALLLPLALLLHAARPEVQLVESGAEVKKPGSSVKVSCKASGGTFSSYAISWVRQAPGQGLEWMGGIIPIFGTANYAQKFQGRVTITADESTSTAYMELSSLRSEDTAVYYCARDHKVVRFGYWGQGTLVTVSSGGGGSGGGGSGGGGSHVILTQPPSASASLGASVKLTCTLSSGHSSYAIAWHQQQPEKGPRYLMKVNSDGSLSKGDGIPDRFSGSTSGAERYLTISSLQSEDEADYYCQTWGSGMAIFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7508 - protein, 485 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGDYYMDVWGKGTTVTVSSGGGGSGGGGSGGGGSQSALTQPASASGSPGQSVTISCTGTSSDVGGYNYVSWYQQHPGKAPKLMIYEVSKRPSGVPDRFSGSKSGNTASLTISGLQAEDEADYYCSSYTSSGTLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7509 - protein, 491 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMSWVRQAPGKGLEWVSYISSSSSTIYYADSVKGRFTISRDNAKNSLYLQMNSLRAEDTAVYYCARDGPIRYFDHSKAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYRNSRDSSGNPYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7510 - protein, 488 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSISTAYMELSRLRSDDTAVYYCAREMDDSSGPDYWGQGTLVTVSSGGGGSGGGGSGGGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7511 - protein, 496 aa, Artificial Sequence
  Description of Artificial Sequence: Synthetic Chimeric Antigen Receptor sequence
MALPVTALLLPLALLLHAARPEVQLVESGAEVKKPGESLKISCKGSGYSFTGSWIGWGRQMPGKGLEWMGIIYPGDSDTRYSPSFQGQVTISADKSISTAYLQWSSLKASDTAMYYCARGFLRGGDCCGALDIWGQGTMVTVSSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPWTFGQGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7512 - protein, 494 aa, Artificial Sequence
  Description of Artificial Sequence: Synthetic Chimeric Antigen Receptor sequence
MALPVTALLLPLALLLHAARPQVQLQESGPGLVKPSETLSLTCSVSGGSINSYYWSWIRQAPGKGLEWIAFTSHSGNVKYNPSLTGRVTIAVDTSKNQFYLEVTSVTAADTAVYFCARGLDPLFAYDAFEIWGLGTMVTVSSGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQVLQTPPLTFGGGTKVDIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7513 - protein, 491 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDFWSGSVDYWGQGTLVTVSSGGGGSGGGGSGGGGSGGGGSSYVLTQPPSVSVAPGKTATITCGGTNIGSKNVHWYQQKPGQAPVLAIYYDSDRPSGIPERFSGSNSGNTATLTISRVEAGDEADYFCQVWDSSSDHWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7514 - protein, 494 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREDDSSGYTSPFDYWGQGTLVTVSSGGGGSGGGGSGGGGSGGGRSSYELTQPPSVSVAPGETASIACGGHNIRSKNVHWYQQKPGQAPVLVISYDGDRPSGIPERFSGSNLGSTATLTISRVEAGDEADYYCQVWDSDSDHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7515 - protein, 284 aa, Artificial Sequence
  Description of Artificial Sequence: Synthetic Chimeric Antigen Receptor sequence
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGAYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTQLTVLGSHHHHHHHH

SEQ ID NO: 7516 - protein, 496 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7517 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASFSSSDSYDYWGQGTLVTVSSGGGGSGGGGSGGGGSGGGGSEIVLTQSPATLSVSPGERATLSCRASQSVTSNLAWYQQKPGQAPRLLIYAASTRATGIPARFSGSGSGTEFTLTISSMQSEDFAVYFCQQYHTWPPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7518 - protein, 498 aa, Artificial Sequence
  Description of Artificial Sequence: Synthetic Chimeric Antigen Receptor sequence
MALPVTALLLPLALLLHAARPQVNLRESGPALVKPTQTLTLTCTFSGFSLNTFGMSVSWIRQPPGKALEWLALIDWDDDKYYSTSLRTRLTISKDTAKNQVVLRMTNMDPMDTATYYCARIYGGDRTNTQAPYFFDLWGQGTLVTVSSGGGGSGGGGSGGGGSDVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7519 - protein, 492 aa, Artificial Sequence
  Description of Artificial Sequence: Synthetic Chimeric Antigen Receptor sequence
MALPVTALLLPLALLLHAARPQVQLQESGPGLVKPSGTLSLTCAVSGASITSRHWWNWVRHSPGKGLEWIGQIYHSGTTTYNPSLGSRVTISVDKSKNQISLELRSVTAADTATYYCVRDYLELATYYGMDVWGQGTTVTVSSGGGGSGGGGSGGGGSEIVLTQSPLSLPVTPGEPASISCRSSQSLLYSDGYNYLDWYLQKPGQSPQLLIYLGSNRASGVPDRFSGSGSGTDFTLQISGVETEDVGVYYCMQALQTQSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7520 - protein, 491 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLAAAGNYYYYGMDVWGQGTTVTVSSGGGGSGGGGSGGGGSSSELTQDPAVSVALGQTARITCQGDSLRSYFTSWYHQKPGQAPVLVIYGNNNRPSGIPDRFSGSSSGNTASLTITGAQAEDEGDYYCDSRDSSGDHLVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7521 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDDFWSGSGAFDIWGQGTTVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHPVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7522 - protein, 492 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARPEGVSYYDSSVLDYWGQGTLVTVSSGGGGSGGGGSGGGGSQSALTQPASVSGSPGQSITISCTGTSSDVGGYKHVSWYQHHPGKAPKLMIYDVSNRPSGVSNRFSGSKSGNTASLTVSGLQAEDEAHYYCVSYRNFNSLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7523 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRAEDTAVYYCARGGYGDYLDAFDIWGQGTTVTVSSGGGGSGGGGSGSGGSQSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTQLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7524 - protein, 490 aa, Artificial Sequence
  Description of Artificial Sequence: Synthetic Chimeric Antigen Receptor sequence
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKGLSSWHFHDALDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGNHLWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7525 - protein, 489 aa, Artificial Sequence
  Description of Artificial Sequence: Synthetic Chimeric Antigen Receptor sequence
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7526 - protein, 498 aa, Artificial Sequence
  Description of Artificial Sequence: Synthetic Chimeric Antigen Receptor sequence
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7527 - protein, 491 aa, Artificial Sequence
  Description of Artificial Sequence: Synthetic Chimeric Antigen Receptor sequence
MALPVTALLLPLALLLHAARPEVQLQQSGPGLVKPSLTLSLTCAISGDSVSSNSATWTWIRQSPSRGLEWLGRTYYRSTWYNDYAVSVKSRITINPDTSKNQFSLQLNSVTPEDTAVYYCAREGSGSYYAYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7528 - protein, 491 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDYWGYYGSGTLDYWGQGTLVTVSSGGGGSGGGGSGGGGSQSALTQPGSVSGSPGQSITISCTGTSSDVGGYNYVSWYQQHPGKAPKLIIYDVSSRPSGVSNRFSGSQSGNTASLTISGLQAEDEADYSCSSYAGSNTLVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7529 - protein, 498 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGLALYSNYVPYYYYGMDVWGQGTTVTVSSGGGGSGGGGSGGGGSNFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNPWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7530 - protein, 485 aa, Artificial Sequence
  Description of Artificial Sequence: Synthetic Chimeric Antigen Receptor sequence
MALPVTALLLPLALLLHAARPEVQLVESGGGLVKPGGSLRLSCVASGFTFSNAWMNWVRQAPGKGLEWVGRIKSKTDGGTADYAAPVKGRFTISRDDSKNTMYLQMNSLKTEDTGVYYCITGATDVWGQGTTVTVSSGGGGSGGGGSGGGGSSYVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7531 - protein, 525 aa, Artificial Sequence
  Description of Artificial Sequence: Synthetic Chimeric Antigen Receptor sequence
MALPVTALLLPLALLLHAARPDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQIGGGGSGGGGSGGGGSQVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7532 - protein, 792 aa, Artificial Sequence
  Description of Artificial Sequence: Synthetic Chimeric Antigen Receptor sequence
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7533 - protein, 506 aa, Artificial Sequence
  Description of Artificial Sequence: Synthetic Chimeric Antigen Receptor sequence
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7534 - protein, 571 aa, Artificial Sequence
  Description of Artificial Sequence: Synthetic Chimeric Antigen Receptor sequence
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7535 - protein, 727 aa, Artificial Sequence
  Description of Artificial Sequence: Synthetic Chimeric Antigen Receptor sequence
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGSSYGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7536 - protein, 792 aa, Artificial Sequence [sequence omitted]

SEQ ID NO: 7537 - protein, 511 aa, Artificial Sequence
  Description of Artificial Sequence: Synthetic Chimeric Antigen Receptor sequence
MVLLVTSLLLCELPHPAFLLIPDTEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGGSGGGGSGGGGSDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAKTTPPSVYGRVKDPKAAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7538 - protein, 484 aa, Artificial Sequence
  Description of Artificial Sequence: Synthetic Chimeric Antigen Receptor sequence
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7539 - protein, 480 aa, Artificial Sequence
  Description of Artificial Sequence: Synthetic Chimeric Antigen Receptor sequence
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7540 - protein, 544 aa, Artificial Sequence
  Description of Artificial Sequence: Synthetic Chimeric Antigen Receptor sequence
MLLLVTSLLLCELPHPAFLLIPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7541 - protein, 711 aa, Artificial Sequence
  Description of Artificial Sequence: Synthetic Chimeric Antigen Receptor sequence
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGSTSGSGKPGSGEGSTKGDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7542 - protein, 729 aa, Artificial Sequence
  Description of Artificial Sequence: Synthetic Chimeric Antigen Receptor sequence
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSGGGGSGGGGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7543 - protein, 737 aa, Artificial Sequence
  Description of Artificial Sequence: Synthetic Chimeric Antigen Receptor sequence
EVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLGWIAVAGTFDYWGQGTLVTVSSGGGGSGGGGSGGGGSQSALTQPASVSGSPGQSITISCTGTSSDVGGYNYVSWYQQHPGKAPKLMIYDVSKRPSGVSNRFSGSKSGNTASLTISGLQAEDEADYYCSSYTSSSLNHVFGTGTKVTVLTGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7544 - protein, 703 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7545 - protein, 707 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7546 - protein, 767 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7547 - protein, 714 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEGAAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7548 - protein, 711 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7549 - protein, 771 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7550 - protein, 701 aa, Artificial Sequence
  Description of Artificial Sequence: Synthetic Chimeric Antigen Receptor sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7551 - protein, 705 aa, Artificial Sequence
  Description of Artificial Sequence: Synthetic Chimeric Antigen Receptor sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7552 - protein, 765 aa, Artificial Sequence
  Description of Artificial Sequence: Synthetic Chimeric Antigen Receptor sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7553 - protein, 466 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7554 - protein, 470 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7555 - protein, 530 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCATGGSGRYALDIWGQGTMVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7556 - protein, 470 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7557 - protein, 474 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7558 - protein, 534 aa, Artificial Sequence
  Description of Artificial Sequence: Synthetic Chimeric Antigen Receptor sequence
QVQLQQSGAEVKKPGSSVKVSCKASGGTFSSYAISWVRQAPGQGLEWMGGIIPILGIANYAQKFQGRVTITADESTSTAYMELSSLRSEDTAVYYCARGGAGGSGSYYPLIWGQGTTVTVSSGGGGSGGGGSGGGGSEIVLTQSPATLSLSPGERATLSCGASQSVSSSYLAWYQQKPGQAPRLLIYDASSRATGIPARFSGSGSGTDFTLTISSLEPEDFAVYYCQQRSSWPPTWTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7559 - protein, 464 aa, Artificial Sequence
  Description of Artificial Sequence: Synthetic Chimeric Antigen Receptor sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7560 - protein, 468 aa, Artificial Sequence
  Description of Artificial Sequence: Synthetic Chimeric Antigen Receptor sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7561 - protein, 528 aa, Artificial Sequence
  Description of Artificial Sequence: Synthetic Chimeric Antigen Receptor sequence
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGGSGGGGSGGGGSEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7562 - protein, 906 aa, Artificial Sequence
  Description of Artificial Sequence: Synthetic Chimeric Antigen Receptor sequence
QVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSGSTSGSGKPGSSEGSTKGDIQMTQSPTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGSTSGSGKPGSSEGSTKGFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 7563 - protein, 978 aa, Artificial Sequence
  Description of Artificial Sequence: Synthetic Chimeric Antigen Receptor sequence
MDFQVQIFSFLLISASVIMSRMAQVQLQQSGAELARPGASVKMSCKASGYTFTTYTIHWVRRRPGHDLEWIGYINPSSGCSDYNQNFKGKTTLTADKSSNTAYMQLNSLTSEDSAVYYCARRADYGNYEYTWFAYWGQGTTVTVSSSGGGSGGGGSGGGGSVIELTQSPKFMSTSVGDRVNVTYKASQNVGTNVAWFQQKPGQSPKVLIYSASYRYSGVPDRFTGSGSGTDFTLTISNVQSEDLAEYFCQQYHTYPLTFGGGTKLEIKRAAAGGGGSGGGGSGGGGSGGGGSGGGGSGGGGSGGGGSGGGGSVDMAQVQLQESGGGLVQPGGSLKLSCAASGFTFSSYGMSWVRQTPDKRLELVATINSNGGSTYYPDSVKGRFTISRDNAKNTLYLQMSSLKSEDTAMYYCARDRDGYDEGFDYWGQGTTVTVSSGGGGSGGGGSGGGGSDIELTQSPSIMSASPGEKVTMTCSASSSVSYMHWYQQKSGTSPKRWIYDTSKLASGVPARFSGSGSGTSYSLTISSMEAEDAATYYCQQWSSNPPTLGRRTQLQLKRADPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQAYAAARDFAAYRSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7564 - protein, 527 aa, Artificial Sequence
  Description of Artificial Sequence: Synthetic Chimeric Antigen Receptor sequence
GSATMAADSQTPWLLTFSLLCLLWPQEAGALPLLHESGAEVAKPGASVKMSCKASGYTFTTYWMHWIKQRPGQGLEWIGYINPSTGYTDYNQNFKDKATLTADKSSRTAYMQLSSLTSEDSTVYYCTRRGPSYGNHGAWFPYWGQGTLVTVSAVSSGGGGSGGGGSGGGGSTNIVMTQSPRSMSMSVGERVTLSCKASENVDTYVSWYQQKPEQSPKLLIYGASNRYTGVPDRFTGSGSATDFTLTISSVQAEDLADYHCGQSYRYPPTFGGGTKLEITRLSNSIMYFSHFVPVFLPAKPTTTPAPRPPTPAPTIASQPLSLRPEACRPAAGGAVHTRGLDFACDIYIWAPLAGTCGVLLLSLVITLYCRSKRGRKKLLYIFKQPFMRPVQTTQEEDGCSCRFPEEEEGGCELEFRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7565 - protein, 252 aa, Artificial Sequence; identical to SEQ ID NO: 5931
  Description of Artificial Sequence: Synthetic Chimeric Antigen Receptor sequence

SEQ ID NO: 7566 - protein, 494 aa, Artificial Sequence
  Description of Artificial Sequence: Synthetic Chimeric Antigen Receptor sequence
MALPVTALLLPLALLLHAARPQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7567 - protein, 436 aa, Artificial Sequence; identical to SEQ ID NO: 6900
  Description of Artificial Sequence: Synthetic Chimeric Antigen Receptor sequence

SEQ ID NO: 7568 - protein, 495 aa, Artificial Sequence
  Description of Artificial Sequence: Synthetic Chimeric Antigen Receptor sequence
MALPVTALLLPLALLLHAARPQVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7569 - protein, 493 aa, Artificial Sequence
  Description of Artificial Sequence: Synthetic Chimeric Antigen Receptor sequence
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7570 - protein, 494 aa, Artificial Sequence
  Description of Artificial Sequence: Synthetic Chimeric Antigen Receptor sequence
MALPVTALLLPLALLLHAARPQVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7571 - protein, 484 aa, Artificial Sequence
  Description of Artificial Sequence: Synthetic Chimeric Antigen Receptor sequence
MALPVTALLLPLALLLHAARPQVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7572 - protein, 492 aa, Artificial Sequence
  Description of Artificial Sequence: Synthetic Chimeric Antigen Receptor sequence
MALPVTALLLPLALLLHAARPQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7573 - protein, 489 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7574 - protein, 489 aa, Artificial Sequence
  Description of Artificial Sequence: Synthetic Chimeric Antigen Receptor sequence
MALPVTALLLPLALLLHAARPQVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7575 - protein, 488 aa, Artificial Sequence
  Description of Artificial Sequence: Synthetic Chimeric Antigen Receptor sequence
MALPVTALLLPLALLLHAARPQVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7576 - protein, 462 aa, Artificial Sequence
  Description of Artificial Sequence: Synthetic Chimeric Antigen Receptor sequence
MALPVTALLLPLALLLHAARPQAYLQQSGAELVRSGASVKMSCKASGYTFTSYNLHWVKQTPGQGLEWIGYIYPGNGGTNYNQKFKGKATLTADTSSSTAYMQISSLTSEDSAVYFCARGGIYYYGSSLDYWGQGTTLTVSSGGGGSGGGGSGGGGSNIVLTQSPASLAVSLGQRATISCRASESVDNYGTTFMYWYQQKPGQPPKLLIYLASNLESGVPARFSGSGSGTDFTLTIDPVEADDAATYYCQQNKEDPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7577 - protein, 439 aa, Artificial Sequence; identical to SEQ ID NO: 6901
  Description of Artificial Sequence: Synthetic Chimeric Antigen Receptor sequence

SEQ ID NO: 7578 - protein, 465 aa, Artificial Sequence; identical to SEQ ID NO: 6902
  Description of Artificial Sequence: Synthetic Chimeric Antigen Receptor sequence

SEQ ID NO: 7579 - protein, 468 aa, Artificial Sequence; identical to SEQ ID NO: 6903
  Description of Artificial Sequence: Synthetic Chimeric Antigen Receptor sequence

SEQ ID NO: 7580 - protein, 651 aa, Artificial Sequence; identical to SEQ ID NO: 6904
  Description of Artificial Sequence: Synthetic Chimeric Antigen Receptor sequence

SEQ ID NO: 7581 - protein, 654 aa, Artificial Sequence; identical to SEQ ID NO: 6905
  Description of Artificial Sequence: Synthetic Chimeric Antigen Receptor sequence

SEQ ID NO: 7582 - protein, 434 aa, Artificial Sequence; identical to SEQ ID NO: 6906
  Description of Artificial Sequence: Synthetic Chimeric Antigen Receptor sequence

SEQ ID NO: 7583 - protein, 437 aa, Artificial Sequence; identical to SEQ ID NO: 6907
  Description of Artificial Sequence: Synthetic Chimeric Antigen Receptor sequence

SEQ ID NO: 7584 - protein, 463 aa, Artificial Sequence; identical to SEQ ID NO: 6908
  Description of Artificial Sequence: Synthetic Chimeric Antigen Receptor sequence

SEQ ID NO: 7585 - protein, 466 aa, Artificial Sequence; identical to SEQ ID NO: 6909
  Description of Artificial Sequence: Synthetic Chimeric Antigen Receptor sequence

SEQ ID NO: 7586 - protein, 649 aa, Artificial Sequence; identical to SEQ ID NO: 6910
  Description of Artificial Sequence: Synthetic Chimeric Antigen Receptor sequence

SEQ ID NO: 7587 - protein, 652 aa, Artificial Sequence
  Description of Artificial Sequence: Synthetic Chimeric Antigen Receptor sequence
QVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7588 - protein, 444 aa, Artificial Sequence; identical to SEQ ID NO: 6912
  Description of Artificial Sequence: Synthetic Chimeric Antigen Receptor sequence

SEQ ID NO: 7589 - protein, 447 aa, Artificial Sequence; identical to SEQ ID NO: 6913
  Description of Artificial Sequence: Synthetic Chimeric Antigen Receptor sequence

SEQ ID NO: 7590 - protein, 473 aa, Artificial Sequence; identical to SEQ ID NO: 6914
  Description of Artificial Sequence: Synthetic Chimeric Antigen Receptor sequence

SEQ ID NO: 7591 - protein, 476 aa, Artificial Sequence; identical to SEQ ID NO: 6915
  Description of Artificial Sequence: Synthetic Chimeric Antigen Receptor sequence

SEQ ID NO: 7592 - protein, 659 aa, Artificial Sequence; identical to SEQ ID NO: 6916
  Description of Artificial Sequence: Synthetic Chimeric Antigen Receptor sequence

SEQ ID NO: 7593 - protein, 662 aa, Artificial Sequence; identical to SEQ ID NO: 6917
  Description of Artificial Sequence: Synthetic Chimeric Antigen Receptor sequence

SEQ ID NO: 7594 - protein, 440 aa, Artificial Sequence; identical to SEQ ID NO: 6918
  Description of Artificial Sequence: Synthetic Chimeric Antigen Receptor sequence

SEQ ID NO: 7595 - protein, 443 aa, Artificial Sequence; identical to SEQ ID NO: 6919
  Description of Artificial Sequence: Synthetic Chimeric Antigen Receptor sequence

SEQ ID NO: 7596 - protein, 469 aa, Artificial Sequence; identical to SEQ ID NO: 6920
  Description of Artificial Sequence: Synthetic Chimeric Antigen Receptor sequence

SEQ ID NO: 7597 - protein, 472 aa, Artificial Sequence; identical to SEQ ID NO: 6921
  Description of Artificial Sequence: Synthetic Chimeric Antigen Receptor sequence

SEQ ID NO: 7598 - protein, 655 aa, Artificial Sequence; identical to SEQ ID NO: 6922
  Description of Artificial Sequence: Synthetic Chimeric Antigen Receptor sequence

SEQ ID NO: 7599 - protein, 658 aa, Artificial Sequence; identical to SEQ ID NO: 6923
  Description of Artificial Sequence: Synthetic Chimeric Antigen Receptor sequence

SEQ ID NO: 7600 - protein, 457 aa, Artificial Sequence
  Description of Artificial Sequence: Synthetic Chimeric Antigen Receptor sequence
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7601 - protein, 460 aa, Artificial Sequence
  Description of Artificial Sequence: Synthetic Chimeric Antigen Receptor sequence
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7602 - protein, 486 aa, Artificial Sequence
  Description of Artificial Sequence: Synthetic Chimeric Antigen Receptor sequence
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7603 - protein, 489 aa, Artificial Sequence
  Description of Artificial Sequence: Synthetic Chimeric Antigen Receptor sequence
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7604 - protein, 672 aa, Artificial Sequence
  Description of Artificial Sequence: Synthetic Chimeric Antigen Receptor sequence
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7605 - protein, 675 aa, Artificial Sequence
  Description of Artificial Sequence: Synthetic Chimeric Antigen Receptor sequence
MALPVTALLLPLALLLHAARPEVQLQQSGPELVKPGASVKISCKASGYTFTDYNMHWVKQSHGKSLEWIGYIYPYNGGTGYNQKFKSKATLTVDNSSSTAYMDVRSLTSEDSAVYYCARGRPAMDYWGQGTSVTVSSGGGGSGGGGSGGGGSDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7606 - protein, 455 aa, Artificial Sequence
  Description of Artificial Sequence: Synthetic Chimeric Antigen Receptor sequence
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7607 - protein, 458 aa, Artificial Sequence
  Description of Artificial Sequence: Synthetic Chimeric Antigen Receptor sequence
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7608 - protein, 484 aa, Artificial Sequence
  Description of Artificial Sequence: Synthetic Chimeric Antigen Receptor sequence
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7609 - protein, 487 aa, Artificial Sequence
  Description of Artificial Sequence: Synthetic Chimeric Antigen Receptor sequence
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7610 - protein, 670 aa, Artificial Sequence
  Description of Artificial Sequence: Synthetic Chimeric Antigen Receptor sequence
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7611 - protein, 673 aa, Artificial Sequence
  Description of Artificial Sequence: Synthetic Chimeric Antigen Receptor sequence
MALPVTALLLPLALLLHAARPQVQLQQSGPELVRPGTFVKISCKASGYTFTNYDINWVNQRPGQGLEWIGWIYPGDGSTKYNEKFKAKATLTADKSSSTAYLQLNNLTSENSAVYFCASGYEDAMDYWGQGTSVTVSSGGGGSGGGGSGGGGSDIKMTQSPSSMYASLGERVIINCKASQDINSYLSWFQQKPGKSPKTLIYRANRLVDGVPSRFSGSGSGQDYSLTISSLEYEDMGIYYCLQYDEFPLTFGAGTKLELKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7612 - protein, 465 aa, Artificial Sequence
  Description of Artificial Sequence: Synthetic Chimeric Antigen Receptor sequence
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7613 - protein, 468 aa, Artificial Sequence
  Description of Artificial Sequence: Synthetic Chimeric Antigen Receptor sequence
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7614 - protein, 494 aa, Artificial Sequence
  Description of Artificial Sequence: Synthetic Chimeric Antigen Receptor sequence
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7615 - protein, 497 aa, Artificial Sequence
  Description of Artificial Sequence: Synthetic Chimeric Antigen Receptor sequence
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7616 - protein, 680 aa, Artificial Sequence
  Description of Artificial Sequence: Synthetic Chimeric Antigen Receptor sequence
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7617 - protein, 683 aa, Artificial Sequence
  Description of Artificial Sequence: Synthetic Chimeric Antigen Receptor sequence
MALPVTALLLPLALLLHAARPEVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSSGGGGSGGGGSGGGGSDIVLTQSPTIMSASPGERVTMTCTASSSVNYIHWYQQKSGDSPLRWIFDTSKVASGVPARFSGSGSGTSYSLTISTMEAEDAATYYCQQWRSYPLTFGDGTRLELKRADAAPTVSEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7618 - protein, 461 aa, Artificial Sequence
  Description of Artificial Sequence: Synthetic Chimeric Antigen Receptor sequence
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7619 - protein, 464 aa, Artificial Sequence
  Description of Artificial Sequence: Synthetic Chimeric Antigen Receptor sequence
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7620 - protein, 490 aa, Artificial Sequence
  Description of Artificial Sequence: Synthetic Chimeric Antigen Receptor sequence
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7621 - protein, 493 aa, Artificial Sequence
  Description of Artificial Sequence: Synthetic Chimeric Antigen Receptor sequence
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7622 - protein, 676 aa, Artificial Sequence
  Description of Artificial Sequence: Synthetic Chimeric Antigen Receptor sequence
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7623 - protein, 679 aa, Artificial Sequence
  Description of Artificial Sequence: Synthetic Chimeric Antigen Receptor sequence
MALPVTALLLPLALLLHAARPQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSSGGGGSGGGGSGGGGSNIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7624 - protein, 442 aa, Artificial Sequence
  Description of Artificial Sequence: Synthetic Chimeric Antigen Receptor sequence
PLALLLHAARPEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDA

SEQ ID NO: 7625 - protein, 491 aa, Artificial Sequence
  Description of Artificial Sequence: Synthetic Chimeric Antigen Receptor sequence
MALPVTALLLPLALLLHAARPQAYLQQSGAELVRSGASVKMSCKASGYTFTSYNLHWVKQTPGQGLEWIGYIYPGNGGTNYNQKFKGKATLTADTSSSTAYMQISSLTSEDSAVYFCARGGIYYYGSSLDYWGQGTTLTVSSGGGGSGGGGSGGGGSNIVLTQSPASLAVSLGQRATISCRASESVDNYGTTFMYWYQQKPGQPPKLLIYLASNLESGVPARFSGSGSGTDFTLTIDPVEADDAATYYCQQNKEDPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7626 - protein, 677 aa, Artificial Sequence
  Description of Artificial Sequence: Synthetic Chimeric Antigen Receptor sequence
MALPVTALLLPLALLLHAARPQAYLQQSGAELVRSGASVKMSCKASGYTFTSYNLHWVKQTPGQGLEWIGYIYPGNGGTNYNQKFKGKATLTADTSSSTAYMQISSLTSEDSAVYFCARGGIYYYGSSLDYWGQGTTLTVSSGGGGSGGGGSGGGGSNIVLTQSPASLAVSLGQRATISCRASESVDNYGTTFMYWYQQKPGQPPKLLIYLASNLESGVPARFSGSGSGTDFTLTIDPVEADDAATYYCQQNKEDPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7627 - protein, 472 aa, Artificial Sequence
  Description of Artificial Sequence: Synthetic Chimeric Antigen Receptor sequence
MALPVTALLLPLALLLHAARPPLALLLHAARPEVQLQQSGAELVRPGASVKLSCTASGFNIKDSLIHWVKQRPEQGLEWIGWIDPEDDKTKYAPKFQDKATLTADTSSNTAYLQLSTLTSEDTAIYYCVSRYINYYFAYWGQGTTLTVSSGGGGSGGGGSGGGGSDIVMTQSPSSLTVTAGEKVTMSCKSSQSLLHSGNQRNYLTWYQQKPGQPPKLLIYWASTRESGVPDRFTGSGSGTDFTLTISSVQAEDLAVYYCQNDYDYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7628 - protein, 490 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDSLIHWVKQRPEQGLEWIGWIDPEDDKTKYAPKFQDKATLTADTSSNTAYLQLSTLTSEDTAIYYCVSRYINYYFAYWGQGTTLTVSSGGGGSGGGGSGGGGSDIVMTQSPSSLTVTAGEKVTMSCKSSQSLLHSGNQRNYLTWYQQKPGQPPKLLIYWASTRESGVPDRFTGSGSGTDFTLTISSVQAEDLAVYYCQNDYDYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7629 - protein, 676 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDSLIHWVKQRPEQGLEWIGWIDPEDDKTKYAPKFQDKATLTADTSSNTAYLQLSTLTSEDTAIYYCVSRYINYYFAYWGQGTTLTVSSGGGGSGGGGSGGGGSDIVMTQSPSSLTVTAGEKVTMSCKSSQSLLHSGNQRNYLTWYQQKPGQPPKLLIYWASTRESGVPDRFTGSGSGTDFTLTISSVQAEDLAVYYCQNDYDYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7630 - protein, 464 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTKYGMNWVKQTPGKGLKWMGWINTNSGEPTYAEEFKGRFAFSLETSASTAYLQINNLKNEDTATYFCARGAYYRYDGEVSYYAMDYWGQGTSVTVSSGGGGSGGGGSGGGGSQIILTQSPAIMSASLGERVTMTCTATSSLSSSYLHWYQQKPGSSPKLWIYSTSHLASGVPARFSGGGSGTSYSLTISSMEAEDAATYYCHQYHLSPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7631 - protein, 493 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTKYGMNWVKQTPGKGLKWMGWINTNSGEPTYAEEFKGRFAFSLETSASTAYLQINNLKNEDTATYFCARGAYYRYDGEVSYYAMDYWGQGTSVTVSSGGGGSGGGGSGGGGSQIILTQSPAIMSASLGERVTMTCTATSSLSSSYLHWYQQKPGSSPKLWIYSTSHLASGVPARFSGGGSGTSYSLTISSMEAEDAATYYCHQYHLSPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7632 - protein, 679 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTKYGMNWVKQTPGKGLKWMGWINTNSGEPTYAEEFKGRFAFSLETSASTAYLQINNLKNEDTATYFCARGAYYRYDGEVSYYAMDYWGQGTSVTVSSGGGGSGGGGSGGGGSQIILTQSPAIMSASLGERVTMTCTATSSLSSSYLHWYQQKPGSSPKLWIYSTSHLASGVPARFSGGGSGTSYSLTISSMEAEDAATYYCHQYHLSPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7633 - protein, 488 aa, Artificial Sequence
  Description of Artificial Sequence: Synthetic Chimeric Antigen Receptor sequence
MALPVTALLLPLALLLHAARPQIQLVQSGPEVKKPGETVKISCKASGYTFTNYGMNWVKQAPGKGLKWMGINTYTGEPTYADAFKGRFAFSLETSASTAYLQINNLKNEDTATYFCARDYGDYGMDYWGQGTSVTVSSGGGGSGGGGSGGGGSDIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7634 - protein, 471 aa, Artificial Sequence
  Description of Artificial Sequence: Synthetic Chimeric Antigen Receptor sequence
PLALLLHAARPEVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDA

SEQ ID NO: 7635 - protein, 657 aa, Artificial Sequence [sequence omitted]

SEQ ID NO: 7636 - protein, 535 aa, Artificial Sequence
  Description of Artificial Sequence: Synthetic Chimeric Antigen Receptor sequence
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7637 - protein, 536 aa, Artificial Sequence
  Description of Artificial Sequence: Synthetic Chimeric Antigen Receptor sequence
MALPVTALLLPLALLLHAARPDIVMTQSPDSLAVSLGERATINCRASKSVSTSGYSYIYWYQQKPGQPPKLLIYLASILESGVPDRFSGSGSGTDFTLTISSLQAEDVAVYYCQHSRELPWTFGQGTKVEIKGGGGSGGGGSGGGGSEEQLVESGGGLVKPGGSLRLSCAASGFSFSDCRMYWLRQAPGKGLEWIGVISVKSENYGANYAESVRGRFTISRDDSKNTVYLQMNSLKTEDTAVYYCSASYYRYDVGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7638 - protein, 692 aa, Artificial Sequence
  Description of Artificial Sequence: Synthetic Chimeric Antigen Receptor sequence
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSQVQLLESGAEVKKPGSSVKVSCKASGDTFIRYSFTWVRQAPGQGLEWMGRIITILDVAHYAPHLQGRVTITADKSTSTVYLELRNLRSDDTAVYFCAGVYEGEADEGEYDNNGFLKHWGQGTLVTVTSGGGGSGGGGSGGGGSELELTQSPATLSVSPGERATLSCRASESVSSDLAWYQQKPGQAPRLLIYGASTRATGVPARFSGSGSGAEFTLTISSLQSEDFAVYYCQQYNNWPPRYTFGQGTRLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7639 - protein, 717 aa, Artificial Sequence [sequence omitted]

SEQ ID NO: 7640 - protein, 669 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7641 - protein, 609 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7642 - protein, 647 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7643 - protein, 587 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7644 - protein, 668 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7645 - protein, 608 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7646 - protein, 646 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7647 - protein, 586 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7648 - protein, 251 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSS

SEQ ID NO: 7649 - protein, 658 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7650 - protein, 598 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7651 - protein, 636 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEIPGRWITRSTPPEGSDSTAPSTQEPEAPPEQDLIASTVAGVVTTVMGSSQPVVTRGTTDNPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7652 - protein, 576 aa, Artificial Sequence
  Description of Artificial Sequence: Synthetic Chimeric Antigen Receptor sequence
MEAPAQLLFLLLLWLPDTTGEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKRGGGGSGGGGSEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGDPKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEAARAADAECEEPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7653 - protein, 576 aa, Artificial Sequence; identical to SEQ ID NO: 7652
  Description of Artificial Sequence: Synthetic Chimeric Antigen Receptor sequence

SEQ ID NO: 7654 - protein, 526 aa, Artificial Sequence
  Description of Artificial Sequence: Synthetic Chimeric Antigen Receptor sequence
MALPVTALLLPLALLLHAARPDIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIKGGGGSGGGGSGGGGSEVQLQESGPGLVKPSQTLSLTCSVTGYSITSGYYWHWIRQFPGNKLQWMGYISYSGFTNYKTSLINRISITHDTSENQFFLNLNSVTTEDTATYYCAGDRTGSWFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7655 - protein, 686 aa, Artificial Sequence
  Description of Artificial Sequence: Synthetic Chimeric Antigen Receptor sequence
MEFGLSWLFLVAILKGVQCIDAMGNIQLVQSGPELKKPGETVKISCKASGYTFTNYGMNWVKQAPGKGLRWMGWINTHTGEPTYADDFKGRFAFSLETSASTAYLQINNLKNEDTATYFCTRRGYDWYFDVWGAGTTVTVSSGGGGSGGGGSGGGGSDIKMTQSPSSMYASLGERVTITCKASQDINSYLSWFHHKPGKSPKTLIYRANRLVDGVPSRFSGSGSGQDYSLTISSLDYEDMGIYYCQQYDESPWTFGGGTKLEMKGSGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7656 - protein, 529 aa, Artificial Sequence
  Description of Artificial Sequence: Synthetic Chimeric Antigen Receptor sequence
MALPVTALLLPLALLLHAARPDIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKGGGGSGGGGSGGGGSQVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7657 - protein, 540 aa, Artificial Sequence
  Description of Artificial Sequence: Synthetic Chimeric Antigen Receptor sequence
MALPVTALLLPLALLLHAARPGAQPAMAAYKDIQMTQTTSSLSASLGDRVTISCSASQGISNYLNWYQQKPDGTNKLLIYYTSSLHSGVPSRFSGSGSGTDYSLHSNLEPEDIATYYCQQYSKLPYTFGGGTKLEIKRGGGGSGGGGSGGGGSGGGGSEVQLVESGGGLVKPGGSLKLSCAASGLTFSSYAMSWNRQTPEKRLEWVASISSGGFTYYPDSNKGRFTISRDNARNILYLQMSSLRSEDTAMYYCARDEVRGYLDVWGAGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7658 - protein, 244 aa, Artificial Sequence
  Description of Artificial Sequence: Synthetic Chimeric Antigen Receptor sequence
GVHSQVQLQESGPGLVRPSQTLSLTCTVSGFTISSGYSWHWVRQPPGRGLEWIGYIQYSGITNYNPSLKSRVTMLVDTSKNQFSLRLSSVTAADTAVYYCAREDYDYHWYFDVWGQGTTVTVSSGGGGSGGGGSGGGGSDIQLTQSPSSLSASVGDRVTITCSTSSSVSYMHWYQQKPGKAPKLLIYSTSNLASGVPSRFSGSGSGTDFTFTISSLQPEDIATYYCHQWSSYPTFGQGTKVEIK

SEQ ID NO: 7659 - protein, 464 aa, Artificial Sequence
  Description of Artificial Sequence: Synthetic Chimeric Antigen Receptor sequence
MALPVTALLLPLALLLHAARPQVQLVESGGGVVQPGRSLRLSCAASGFTFSNYGIHWVRQAPGKGLEWVAVIWYDGSNKYYADSVKGRFTISRDNSKNTLYLQMNSLRAEDTAVYYCARDGGYSGYDSGFDYWGQGTLVTVSSGGGGSGGGGSGGGGSDIVMTQSPLSLPVTPGEPASISCRSSQSLLNSNGYNYLDWYLQKPGQSPQFLIYLGSYRASGVPDRFSGSGSGTDFTLRISRVEAEDVGVYYCIQTLQTPFTFGPGTKVDIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7660 - protein, 493 aa, Artificial Sequence
  Description of Artificial Sequence: Synthetic Chimeric Antigen Receptor sequence
MALPVTALLLPLALLLHAARPQVQLVESGGGVVQPGRSLRLSCAASGFTFSNYGIHWVRQAPGKGLEWVAVIWYDGSNKYYADSVKGRFTISRDNSKNTLYLQMNSLRAEDTAVYYCARDGGYSGYDSGFDYWGQGTLVTVSSGGGGSGGGGSGGGGSDIVMTQSPLSLPVTPGEPASISCRSSQSLLNSNGYNYLDWYLQKPGQSPQFLIYLGSYRASGVPDRFSGSGSGTDFTLRISRVEAEDVGVYYCIQTLQTPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7661 - protein, 459 aa, Artificial Sequence
  Description of Artificial Sequence: Synthetic Chimeric Antigen Receptor sequence
MALPVTALLLPLALLLHAARPQVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7662 - protein, 455 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7663 - protein, 584 aa, Artificial Sequence
  Description of Artificial Sequence: Synthetic Chimeric Antigen Receptor sequence
MALPVTALLLPLALLLHAARPQVQLVESGGGVVQPGRSLRLSCAASGFTFSNYGIHWVRQAPGKGLEWVAVIWYDGSNKYYADSVKGRFTISRDNSKNTLYLQMNSLRAEDTAVYYCARDGGYSGYDSGFDYWGQGTLVTVSSGGGGSGGGGSGGGGSDIVMTQSPLSLPVTPGEPASISCRSSQSLLNSNGYNYLDWYLQKPGQSPQFLIYLGSYRASGVPDRFSGSGSGTDFTLRISRVEAEDVGVYYCIQTLQTPFTFGPGTKVDIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQ

SEQ ID NO: 7664 - protein, 488 aa, Artificial Sequence
  Description of Artificial Sequence: Synthetic Chimeric Antigen Receptor sequence
MALPVTALLLPLALLLHAARPQVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7665 - protein, 674 aa, Artificial Sequence
  Description of Artificial Sequence: Synthetic Chimeric Antigen Receptor sequence
MALPVTALLLPLALLLHAARPQVQLVESGGGVVQPGRSLRLSCAASGFTFSSYGMHWVRQAPGKGLEWVAVIWYDGSDKYFADSVKGRFTISRDNSKNTLYLQMNSLRAEDTAVYYCARDGIAGARYVYFDYWGQGTLVTVSSGGGGSGGGGSGGGGSDIQMTQSPSSLSASVGDRVTITCRASQGISNYLAWFQQKPGKAPKSLIYAASSLQGGVPSKFSGSGSGTDFTLTISSLQPEDFATYYCQQYYNYPFTFGPGTTVDIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7666 - protein, 741 aa, Artificial Sequence
  Description of Artificial Sequence: Synthetic Chimeric Antigen Receptor sequence
AQLEKELQALEKENAQLEWELQALEKELAQSGGGGSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSAQLEKKLQALKKKNAQLKWKLQALKKKLAQ

SEQ ID NO: 7667 - protein, 719 aa, Artificial Sequence
  Description of Artificial Sequence: Synthetic Chimeric Antigen Receptor sequence
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKPGVQPSPPVISLLYSATEEQRGNGFVQLICLISGYYFFIPLLVVILFAVDTGLFISTQQQVTFLLKIKRTRKGFRLLNPHPKPNPKNNRAEGRGSLLTCGDVEENPGPMDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEKRGRKKLLYIFKQPFMRPVQTTQEEDGCSCRFPEEEEGGCELGSGVKQTLNFDLLKLAGDVESNPGPMIPAVVLLLLLLVEQAAALGEPQLCYILDAILFLYGIVLTLLYCRLKIQVRKAAITSYEKSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7668 - protein, 513 aa, Artificial Sequence
  Description of Artificial Sequence: Synthetic Chimeric Antigen Receptor sequence
MSVPTQVLGLLLLWLTGARCDIQMTQSPASLSASVGDTVTITCRASENIYSYLAWYQQKQGKSPQLLVYNAKALSEGVPSRFSGSGSGTQFSLRINSLQPEDFGDYYCQHHYNSPYTFGGGTKLEIKGSTSGSGKSSEGKGQIQLVQSGPELKKPGETVKISCKASGYSFTNDGINWVKQAPGKGFKYMGWINTITGEPTYTEDFKGRFAFSLETSASTAYLQINNLKDEDTATFFCAKGTGTSAYWGQGTLVTVSATSLSNSIMYFSHFVPVFLPAKPTTTPAPRPPTPAPTIASQPLSLRPEACRPAAGGAVHTRGLDSRFWVLVVVGGVLACYSLLVTVAFIIFWVRLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWV

SEQ ID NO: 7669 - protein, 553 aa, Artificial Sequence
  Description of Artificial Sequence: Synthetic Chimeric Antigen Receptor sequence
MSVPTQVLGLLLLWLTGARCDIQMTQSPASLSASVGDTVTITCRASENIYSYLAWYQQKQGKSPQLLVYNAKALSEGVPSRFSGSGSGTQFSLRINSLQPEDFGDYYCQHHYNSPYTFGGGTKLEIKGSTSGSGKSSEGKGQIQLVQSGPELKKPGETVKISCKASGYSFTNDGINWVKQAPGKGFKYMGWINTITGEPTYTEDFKGRFAFSLETSASTAYLQINNLKDEDTATFFCAKGTGTSAYWGQGTLVTVSATSLSNSIMYFSHFVPVFLPAKPTTTPAPRPPTPAPTIASQPLSLRPEACRPAAGGAVHTRGLDSRFWVLVVVGGVLACYSLLVTVAFIIFWVRLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWVSKRSRLLHSDYMNMTPRRPGPTRKHYQPYAPPRDFAAYRS

SEQ ID NO: 7670 - protein, 793 aa, Artificial Sequence
  Description of Artificial Sequence: Synthetic Chimeric Antigen Receptor sequence
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGVKQTLNFDLLKLAGDVESNPGPMALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7671 - protein, 918 aa, Artificial Sequence
  Description of Artificial Sequence: Synthetic Chimeric Antigen Receptor sequence
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFFIPLLVVILFAVDTGLFISTQQQVTFLLKIKRTRKGFRLLNPHPKPNPKNNRAEGRGSLLTCGDVEENPGPMDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEKRGRKKLLYIFKQPFMRPVQTTQEEDGCSCRFPEEEEGGCELGSGVKQTLNFDLLKLAGDVESNPGPMIPAVVLLLLLLVEQAAALGEPQLCYILDAILFLYGIVLTLLYCRLKIQVRKAAITSYEKSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7672 - protein, 728 aa, Artificial Sequence
  Description of Artificial Sequence: Synthetic Chimeric Antigen Receptor sequence
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKTTTPAPRPPTPAPTIASQPLSLRPEACRPAAGGAVHTRGLDFACDFFIPLLVVILFAVDTGLFISTQQQVTFLLKIKRTRKGFRLLNPHPKPNPKNNRAEGRGSLLTCGDVEENPGPMDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEKRGRKKLLYIFKQPFMRPVQTTQEEDGCSCRFPEEEEGGCELGSGVKQTLNFDLLKLAGDVESNPGPMIPAVVLLLLLLVEQAAALGEPQLCYILDAILFLYGIVLTLLYCRLKIQVRKAAITSYEKSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7673 - protein, 370 aa, Artificial Sequence
  Description of Artificial Sequence: Synthetic Chimeric Antigen Receptor sequence
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKPGVQPSPPVISLLYSATEEQRGNGFVQLICLISGYYIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7674 - protein, 569 aa, Artificial Sequence
  Description of Artificial Sequence: Synthetic Chimeric Antigen Receptor sequence
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7675 - protein, 379 aa, Artificial Sequence
  Description of Artificial Sequence: Synthetic Chimeric Antigen Receptor sequence
MAPAMESPTLLCVALLFFAPDGVLAMNIFLLSVLLALLPNVFTARVDQTPRTATKETGESLTINCVLRDTSCAFSSTGWYRTKLGSTNEQSISIGGRYVETVNKGSKSFSLRISDLRVEDSGTYKCQAYVIATMAPLCYASYSWNEKGAGTVLTVKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7676 - protein, 743 aa, Artificial Sequence
  Description of Artificial Sequence: Synthetic Chimeric Antigen Receptor sequence
VQIEYLAKQIVDNAIQQASGGGGSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSSHIQIPPGLTELLQGYTVEVLRQQPPDLVEFAVEYFTRLREARA

SEQ ID NO: 7677 - protein, 704 aa, Artificial Sequence
  Description of Artificial Sequence: Synthetic Chimeric Antigen Receptor sequence
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGVKQTLNFDLLKLAGDVESNPGPMALPVTALLLPLALLLHAARPEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTGGGGSGGGGSGGGGSDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7678 - protein, 793 aa, Artificial Sequence
  Description of Artificial Sequence: Synthetic Chimeric Antigen Receptor sequence
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGVKQTLNFDLLKLAGDVESNPGPMALPVTALLLPLALLLHAARPEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTVVTVSTGGGGSGGGGSGGGGSDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7679 - protein, 493 aa, Artificial Sequence
  Description of Artificial Sequence: Synthetic Chimeric Antigen Receptor sequence
MALPVTALLLPLALLLHAARPEVQLVQSGAEVKKPGASVKMSCKASGYTFTSYFIHWVRQAPGQGLEWIGFINPYNDGSKYAQKFQGRATLTSDKSTSTVYMELSSLRSEDTAVYYCTRDDGYYGYAMDYWGQGTLVTVSSASGGGGSGGGGSGGGGSDIQMTQSPSSLSASVGDRVTLTCRATQELSGYLSWLQQKPGKAIKRLIYAASTLDSGVPSRFSGNRAGTDYTLTISSLQPEDFATYYCLQYAIYPYTFGQGTKLEIKRTRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELSARVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7680 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDSGGSRWYADSVKGRFTISRDNSKNTLYLQMNSLRAEDTAVYYCTRYWPMDIWGQGTLVTVSSGGGGSGGGGSGGGGSEIVLTQSPGTLSLSPGERATLSCRASVRVSSTYLAWYQQKPGQAPRLLMYDASIRATGIPDRFSGSGSGTDFTLTISRLEPEDFAVYYCQQYMKWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7681 - protein, 458 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7682 - protein, 484 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7683 - protein, 487 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7684 - protein, 670 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7685 - protein, 673 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARSSSGGFFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7686 - protein, 455 aa, Artificial Sequence; identical to SEQ ID NO: 7662
  Description of Artificial Sequence: Synthetic Chimeric Antigen Receptor sequence

SEQ ID NO: 7687 - protein, 458 aa, Artificial Sequence; identical to SEQ ID NO: 7681
  Description of Artificial Sequence: Synthetic Chimeric Antigen Receptor sequence

SEQ ID NO: 7688 - protein, 484 aa, Artificial Sequence; identical to SEQ ID NO: 7682
  Description of Artificial Sequence: Synthetic Chimeric Antigen Receptor sequence

SEQ ID NO: 7689 - protein, 487 aa, Artificial Sequence; identical to SEQ ID NO: 7683
  Description of Artificial Sequence: Synthetic Chimeric Antigen Receptor sequence

SEQ ID NO: 7690 - protein, 670 aa, Artificial Sequence; identical to SEQ ID NO: 7684
  Description of Artificial Sequence: Synthetic Chimeric Antigen Receptor sequence

SEQ ID NO: 7691 - protein, 673 aa, Artificial Sequence; identical to SEQ ID NO: 7685
  Description of Artificial Sequence: Synthetic Chimeric Antigen Receptor sequence

SEQ ID NO: 7692 - protein, 455 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7693 - protein, 458 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7694 - protein, 484 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7695 - protein, 487 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7696 - protein, 670 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7697 - protein, 673 aa, Artificial Sequence
  Description of Artificial Sequence: Synthetic Chimeric Antigen Receptor sequence
MALPVTALLLPLALLLHAARPQVQLQESGPGLVKPSETLSLTCVVSGGSISSSNWWSWVRQPPGKGLEWIGEIYHSGSPNYNPSLKSRVTISVDKSKNQFSLKLSSVTAADTAVYYCARQTTAGSFDYWGQGTLVTVSSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7698 - protein, 458 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7699 - protein, 461 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7700 - protein, 487 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7701 - protein, 490 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7702 - protein, 673 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7703 - protein, 676 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGGSGGGGSGGGGSDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7704 - protein, 463 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7705 - protein, 466 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7706 - protein, 492 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7707 - protein, 495 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7708 - protein, 678 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7709 - protein, 681 aa, Artificial Sequence
  Description of Artificial Sequence: Synthetic Chimeric Antigen Receptor sequence
MALPVTALLLPLALLLHAARPEVQLQQSGPELVKPGASVKMSCKASGYTFTSYVMHWVKQKPGQGLEWIGYINPYNDGTKYNEKFKGKATLTSDTSSSTAYMELNSLTSEDSAVYFSCCARPIYFDNDYFDYWGQGTTLKVSSGGGGSGGGGSGGGGSTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7710 - protein, 459 aa, Artificial Sequence
  Description of Artificial Sequence: Synthetic Chimeric Antigen Receptor sequence
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7711 - protein, 462 aa, Artificial Sequence
  Description of Artificial Sequence: Synthetic Chimeric Antigen Receptor sequence
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7712 - protein, 488 aa, Artificial Sequence
  Description of Artificial Sequence: Synthetic Chimeric Antigen Receptor sequence
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7713 - protein, 491 aa, Artificial Sequence
  Description of Artificial Sequence: Synthetic Chimeric Antigen Receptor sequence
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7714 - protein, 674 aa, Artificial Sequence
  Description of Artificial Sequence: Synthetic Chimeric Antigen Receptor sequence
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7715 - protein, 677 aa, Artificial Sequence
  Description of Artificial Sequence: Synthetic Chimeric Antigen Receptor sequence
MALPVTALLLPLALLLHAARPEVQLQQSGPELVKPGASMKISCKASGYSFTGYTMNWVKQSHEKNLEWIGPINPYNDGTIYNPNFKGKATLTVDKASSTAYMELLSLTSDDPAVYYSCCARTDDYDDYTMDYWGQGTSVTVSSGGGGSGGGGSGGGGSEIQMTQTPSSLSASLGDRVTISCRASHDISNYLNWYQQKPDGTLKLLIYYTSRLHSGVPSRFSGSGSGTDYSLTISNLEQEDIATYFCQQGKTLLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7716 - protein, 464 aa, Artificial Sequence
  Description of Artificial Sequence: Synthetic Chimeric Antigen Receptor sequence
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7717 - protein, 467 aa, Artificial Sequence
  Description of Artificial Sequence: Synthetic Chimeric Antigen Receptor sequence
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7718 - protein, 493 aa, Artificial Sequence
  Description of Artificial Sequence: Synthetic Chimeric Antigen Receptor sequence
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7719 - protein, 496 aa, Artificial Sequence
  Description of Artificial Sequence: Synthetic Chimeric Antigen Receptor sequence
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7720 - protein, 679 aa, Artificial Sequence
  Description of Artificial Sequence: Synthetic Chimeric Antigen Receptor sequence
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7721 - protein, 682 aa, Artificial Sequence
  Description of Artificial Sequence: Synthetic Chimeric Antigen Receptor sequence
MALPVTALLLPLALLLHAARPQVQLQQPGAELVKPGASVKLSCKASGYTFTRYWMHWVKQRPGQGLEWIGNIDPSDTETHYNQQFKDKATLTVDKSSSTAYMQLSSLTSEDSAVYYCAIYYGNPSYYAMDYWGQGTSVTVSSGGGGSGGGGSGGGGSDIVMTQSPSSLTVTAGEKVTMSCKSSQNLLNSGNQKKYLNWYQQKPGQPPKLLIYWASTRESGVPDRFTGSGSGTDFTLTISSVQAEDLAVYFCQNDYSYPFTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7722 - protein, 457 aa, Artificial Sequence
  Description of Artificial Sequence: Synthetic Chimeric Antigen Receptor sequence
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7723 - protein, 460 aa, Artificial Sequence
  Description of Artificial Sequence: Synthetic Chimeric Antigen Receptor sequence
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7724 - protein, 486 aa, Artificial Sequence
  Description of Artificial Sequence: Synthetic Chimeric Antigen Receptor sequence
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7725 - protein, 489 aa, Artificial Sequence
  Description of Artificial Sequence: Synthetic Chimeric Antigen Receptor sequence
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7726 - protein, 672 aa, Artificial Sequence
  Description of Artificial Sequence: Synthetic Chimeric Antigen Receptor sequence
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7727 - protein, 675 aa, Artificial Sequence
  Description of Artificial Sequence: Synthetic Chimeric Antigen Receptor sequence
MALPVTALLLPLALLLHAARPEVQLQQSGPELVKPGASVKMSCKASGYIFTSYVMYWVKQKPGQGLEWIGYINPYNDGTKYNEKFKGKATLTSDKSSSTAYMELSSLTSEDSAVYYSCCARYYDYDYYFDYWGQGTTLTVSSGGGGSGGGGSGGGGSDIQMTQSPSSLSASLGGKVTITCKASQDINKYIAWYQHKPGKGPRLLIHYTSTLQPGIPSRFSGSGSGRDYSFSISNLEPEDIATYYCLQYDYLWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7728 - protein, 458 aa, Artificial Sequence
  Description of Artificial Sequence: Synthetic Chimeric Antigen Receptor sequence
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7729 - protein, 461 aa, Artificial Sequence
  Description of Artificial Sequence: Synthetic Chimeric Antigen Receptor sequence
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7730 - protein, 487 aa, Artificial Sequence
  Description of Artificial Sequence: Synthetic Chimeric Antigen Receptor sequence
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7731 - protein, 490 aa, Artificial Sequence
  Description of Artificial Sequence: Synthetic Chimeric Antigen Receptor sequence
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7732 - protein, 673 aa, Artificial Sequence
  Description of Artificial Sequence: Synthetic Chimeric Antigen Receptor sequence
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7733 - protein, 676 aa, Artificial Sequence
  Description of Artificial Sequence: Synthetic Chimeric Antigen Receptor sequence
MALPVTALLLPLALLLHAARPEVQLRQSGPELVKPGASVKMSCKASGYTFTSYFMHWVKQKPGQGLEWIGFINPYNDGTKYNEKFKGKATLTSDKSSSTAYMELNSLTSEDSAVYYCTRDDGYYDYAMDYWGQGTSVTVSSGGGGSGGGGSGGGGSDIQMTQSPSSLSASLGERVSLTCRASQEISVYLSWLQQKPDGTIKRLIYAASTLDSGVPERFSGSRSGSDYSLTISSLESEDFADYYCLQYASYPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7734 - protein, 457 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7735 - protein, 460 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7736 - protein, 486 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7737 - protein, 489 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7738 - protein, 672 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7739 - protein, 675 aa, Artificial Sequence
  Description of Artificial Sequence: Synthetic Chimeric Antigen Receptor sequence
MALPVTALLLPLALLLHAARPEVQLQQSGAELVRPGASVKLSCTASGFNIKDDYIHWVKQRPEQGLEWIGWIDPEKGDTAYASKFQDKATITSDTSSNTAYLQLSSLTSEDTAVYYCTLTGRFDYWGQGTTLTVSSGGGGSGGGGSGGGGSDIVMSQSPSSLAVSVGEKVTMSCKSSQSLLYSSNQKNNLAWYQQKPGQSPKLLIYWASTRESGVPDRFTGSGSGTDFTLTISSVQAEDLAVYYCQQYYSYRTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7740 - protein, 461 aa, Artificial Sequence
  Description of Artificial Sequence: Synthetic Chimeric Antigen Receptor sequence
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7741 - protein, 464 aa, Artificial Sequence
  Description of Artificial Sequence: Synthetic Chimeric Antigen Receptor sequence
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7742 - protein, 490 aa, Artificial Sequence
  Description of Artificial Sequence: Synthetic Chimeric Antigen Receptor sequence
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7743 - protein, 493 aa, Artificial Sequence
  Description of Artificial Sequence: Synthetic Chimeric Antigen Receptor sequence
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7744 - protein, 676 aa, Artificial Sequence
  Description of Artificial Sequence: Synthetic Chimeric Antigen Receptor sequence
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7745 - protein, 679 aa, Artificial Sequence
  Description of Artificial Sequence: Synthetic Chimeric Antigen Receptor sequence
MALPVTALLLPLALLLHAARPQVQLQQPGAELVKPGASMKMSCKASGYTFPSSNIHWLKQTPGQGLEWIGVIYPGNGDTSYNQKFKDKATLTTDKSSSTAYMQLSSLTSEDSAIYFSCCARVYNWHFDVWGAGTTVTVSSGGGGSGGGGSGGGGSNIVLTQSPASLAVSLGQRATISCRASESVDGYGDIFMLWYQQKPGQPPKLLIYFASNLESGVPARFSGSGSRTDFTLTIDPVEADDAATYYCQQNNEDPYTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7746 - protein, 456 aa, Artificial Sequence
  Description of Artificial Sequence: Synthetic Chimeric Antigen Receptor sequence
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7747 - protein, 459 aa, Artificial Sequence
  Description of Artificial Sequence: Synthetic Chimeric Antigen Receptor sequence
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7748 - protein, 485 aa, Artificial Sequence
  Description of Artificial Sequence: Synthetic Chimeric Antigen Receptor sequence
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7749 - protein, 488 aa, Artificial Sequence
  Description of Artificial Sequence: Synthetic Chimeric Antigen Receptor sequence
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7750 - protein, 671 aa, Artificial Sequence
  Description of Artificial Sequence: Synthetic Chimeric Antigen Receptor sequence
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7751 - protein, 674 aa, Artificial Sequence
  Description of Artificial Sequence: Synthetic Chimeric Antigen Receptor sequence
MALPVTALLLPLALLLHAARPQVQLQQPGAELVKPGTSVKLSCKASGYTFTRYWMHWVKQRPGQGLEWIGMIHPSSGSTSYNEKVKNKATLTVDRSSTTAYMQLSSLTSEDSAVYYCARDGDYYYGTGDYWGQGTTLTVSSGGGGSGGGGSGGGGSQIVLSQSPAILSASPGEKVTMTCRASSSINYMHWYQQKPGSSPKPWIFATSNLASGVPSRFSGSGSGTSYSLTISRVEAEDAATYYCQQWRSDRALTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7752 - protein, 460 aa, Artificial Sequence
  Description of Artificial Sequence: Synthetic Chimeric Antigen Receptor sequence
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7753 - protein, 463 aa, Artificial Sequence
  Description of Artificial Sequence: Synthetic Chimeric Antigen Receptor sequence
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7754 - protein, 489 aa, Artificial Sequence
  Description of Artificial Sequence: Synthetic Chimeric Antigen Receptor sequence
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7755 - protein, 492 aa, Artificial Sequence
  Description of Artificial Sequence: Synthetic Chimeric Antigen Receptor sequence
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7756 - protein, 675 aa, Artificial Sequence
  Description of Artificial Sequence: Synthetic Chimeric Antigen Receptor sequence
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7757 - protein, 678 aa, Artificial Sequence
  Description of Artificial Sequence: Synthetic Chimeric Antigen Receptor sequence
MALPVTALLLPLALLLHAARPDIQLQESGPGLVKPSQSLSLTCSVTGYSITSAYYWNWIRQFPGNKLEWMGYISYDGRNNYNPSLKNRISITRDTSKNQFFLKLNSVTTEDTATYYCAKEGDYDVGNYYAMDYWGQGTSVTVSSGGGGSGGGGSGGGGSENVLTQSPAIMSASPGEKVTMTCRASSNVISSYVHWYQQRSGASPKLWIYSTSNLASGVPARFSGSGSGTSYSLTISSVEAEDAATYYCQQYSGYPLTFGAGTKLELEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7758 - protein, 491 aa, Artificial Sequence
  Description of Artificial Sequence: Synthetic Chimeric Antigen Receptor sequence
MALPVTALLLPLALLLHAARPEVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7759 - protein, 489 aa, Artificial Sequence
  Description of Artificial Sequence: Synthetic Chimeric Antigen Receptor sequence
MALPVTALLLPLALLLHAARPEVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7760 - protein, 491 aa, Artificial Sequence
  Description of Artificial Sequence: Synthetic Chimeric Antigen Receptor sequence
MALPVTALLLPLALLLHAARPQVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSSGGGGSGGGGSGGGGSDIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7761 - protein, 483 aa, Artificial Sequence
  Description of Artificial Sequence: Synthetic Chimeric Antigen Receptor sequence
MALPVTALLLPLALLLHAARPQVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSSGGGGSGGGGSGGGGSEIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7762 - protein, 489 aa, Artificial Sequence
  Description of Artificial Sequence: Synthetic Chimeric Antigen Receptor sequence
MALPVTALLLPLALLLHAARPEVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSSGGGGSGGGGSGSGGSDIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7763 - protein, 493 aa, Artificial Sequence
  Description of Artificial Sequence: Synthetic Chimeric Antigen Receptor sequence
MALPVTALLLPLALLLHAARPQVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSSGGGGSGGGDSGGGGSDIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7764 - protein, 499 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7765 - protein, 483 aa, Artificial Sequence
  Description of Artificial Sequence: Synthetic Chimeric Antigen Receptor sequence
MALPVTALLLPLALLLHAARPQVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7766 - protein, 490 aa, Artificial Sequence
  Description of Artificial Sequence: Synthetic Chimeric Antigen Receptor sequence
MALPVTALLLPLALLLHAARPQVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSSGGGGSGGGGSGGGGSGGGGSDIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7767 - protein, 492 aa, Artificial Sequence
  Description of Artificial Sequence: Synthetic Chimeric Antigen Receptor sequence
MALPVTALLLPLALLLHAARPQVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSSGGGGSGGGGSGGGGSGGGGSDIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7768 - protein, 490 aa, Artificial Sequence
  Description of Artificial Sequence: Synthetic Chimeric Antigen Receptor sequence
MALPVTALLLPLALLLHAARPEVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSSGGGGSGGGGSGGGGSGGGGSEIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7769 - protein, 499 aa, Artificial Sequence
  Description of Artificial Sequence: Synthetic Chimeric Antigen Receptor sequence
MALPVTALLLPLALLLHAARPQVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSSGGGGSGGGGSGGGGSGGGGSDIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7770 - protein, 491 aa, Artificial Sequence
  Description of Artificial Sequence: Synthetic Chimeric Antigen Receptor sequence
MALPVTALLLPLALLLHAARPQVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7771 - protein, 489 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7772 - protein, 535 aa, Artificial Sequence
  Description of Artificial Sequence: Synthetic Chimeric Antigen Receptor sequence
MALPVTALLLPLALLLHAARPGSEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7773 - protein, 482 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDSGGSRWYADSVKGRFTISRDNSKNTLYLQMNSLRAEDTAVYYCTRYWPMDIWGQGTLVTVSSGGGGSGGGGSGGGGSEIVLTQSPGTLSLSPGERATLSCRASVRVSSTYLAWYQQKPGQAPRLLMYDASIRATGIPDRFSGSGSGTDFTLTISRLEPEDFAVYYCQQYMKWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7774 - protein, 668 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDSGGSRWYADSVKGRFTISRDNSKNTLYLQMNSLRAEDTAVYYCTRYWPMDIWGQGTLVTVSSGGGGSGGGGSGGGGSEIVLTQSPGTLSLSPGERATLSCRASVRVSSTYLAWYQQKPGQAPRLLMYDASIRATGIPDRFSGSGSGTDFTLTISRLEPEDFAVYYCQQYMKWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7775 - protein, 487 aa, Artificial Sequence
  Description of Artificial Sequence: Synthetic Chimeric Antigen Receptor sequence
MALPVTALLLPLALLLHAARPQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGGSGGGGSGGGGSDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7776 - protein, 433 aa, Artificial Sequence
  Description of Artificial Sequence: Synthetic Chimeric Antigen Receptor sequence
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSETTVTQSPASLSMAIGEKVTIRCITSTDIDDDMNWYQQKPGEPPKLLISEGNTLRPGVPSRFSSSGYGTDFVFTIENMLSEDVADYYCLQSDNLPLTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7777 - protein, 434 aa, Artificial Sequence
  Description of Artificial Sequence: Synthetic Chimeric Antigen Receptor sequence
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7778 - protein, 434 aa, Artificial Sequence
  Description of Artificial Sequence: Synthetic Chimeric Antigen Receptor sequence
MALPVTALLLPLALLLHAARPQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGGSGGGGSGGGGSDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7779 - protein, 649 aa, Artificial Sequence
  Description of Artificial Sequence: Synthetic Chimeric Antigen Receptor sequence
MALPVTALLLPLALLLHAARPQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGGSGGGGSGGGGSDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7780 - protein, 432 aa, Artificial Sequence
  Description of Artificial Sequence: Synthetic Chimeric Antigen Receptor sequence
MALPVTALLLPLALLLHAARPEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPDGNYWYFDVWGAGTTVTVSSGGGGSGGGGSGGGGSDIVMTQSHKFMSTSVGDRVSITCKASQDVGIAVAWYQQKPGQSPKLLIYWASTRHTGVPDRFTGSGSGTDFTLTISNVQSEDLADYFCQQYSSYPYTFGGGTKLEIKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7781 - protein, 485 aa, Artificial Sequence
  Description of Artificial Sequence: Synthetic Chimeric Antigen Receptor sequence
MALPVTALLLPLALLLHAARPEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPDGNYWYFDVWGAGTTVTVSSGGGGSGGGGSGGGGSDIVMTQSHKFMSTSVGDRVSITCKASQDVGIAVAWYQQKPGQSPKLLIYWASTRHTGVPDRFTGSGSGTDFTLTISNVQSEDLADYFCQQYSSYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7782 - protein, 647 aa, Artificial Sequence
  Description of Artificial Sequence: Synthetic Chimeric Antigen Receptor sequence
MALPVTALLLPLALLLHAARPEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPDGNYWYFDVWGAGTTVTVSSGGGGSGGGGSGGGGSDIVMTQSHKFMSTSVGDRVSITCKASQDVGIAVAWYQQKPGQSPKLLIYWASTRHTGVPDRFTGSGSGTDFTLTISNVQSEDLADYFCQQYSSYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7783 - protein, 433 aa, Artificial Sequence
  Description of Artificial Sequence: Synthetic Chimeric Antigen Receptor sequence
MALPVTALLLPLALLLHAARPQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGLAVSTISSFFPPGYQKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7784 - protein, 486 aa, Artificial Sequence
  Description of Artificial Sequence: Synthetic Chimeric Antigen Receptor sequence
MALPVTALLLPLALLLHAARPQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7785 - protein, 648 aa, Artificial Sequence
  Description of Artificial Sequence: Synthetic Chimeric Antigen Receptor sequence
MALPVTALLLPLALLLHAARPQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7786 - protein, 487 aa, Artificial Sequence; identical to SEQ ID NO: 7775
  Description of Artificial Sequence: Synthetic Chimeric Antigen Receptor sequence

SEQ ID NO: 7787 - protein, 648 aa, Artificial Sequence
  Description of Artificial Sequence: Synthetic Chimeric Antigen Receptor sequence
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSETTVTQSPASLSMAIGEKVTIRCITSTDIDDDMNWYQQKPGEPPKLLISEGNTLRPGVPSRFSSSGYGTDFVFTIENMLSEDVADYYCLQSDNLPLTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7788 - protein, 487 aa, Artificial Sequence
  Description of Artificial Sequence: Synthetic Chimeric Antigen Receptor sequence
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7789 - protein, 649 aa, Artificial Sequence
  Description of Artificial Sequence: Synthetic Chimeric Antigen Receptor sequence
MALPVTALLLPLALLLHAARPQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGGSGGGGSGGGGSDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7790 - protein, 459 aa, Artificial Sequence
  Description of Artificial Sequence: Synthetic Chimeric Antigen Receptor sequence
MGWSSIILFLVATATGVHSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSGGGGSGGGGSGGGGSDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7791 - protein, 488 aa, Artificial Sequence
  Description of Artificial Sequence: Synthetic Chimeric Antigen Receptor sequence
MALPVTALLLPLALLLHAARPGSDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7792 - protein, 719 aa, Artificial Sequence
  Description of Artificial Sequence: Synthetic Chimeric Antigen Receptor sequence
ADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKMALIVLGGVAGLLLFIGLGIFFMALIVLGGVAGLLLFIGLGIFFCVRCRHRRRSGGGGSSHIQIPPGLTELLQGYTVEVLRQQPPDLVEFAVEYFTRLREARA

SEQ ID NO: 7793 - protein, 671 aa, Artificial Sequence
  Description of Artificial Sequence: Synthetic Chimeric Antigen Receptor sequence
MLTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVVRAEGRGSLLTCGDVEENPGPMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7794 - protein, 491 aa, Artificial Sequence
  Description of Artificial Sequence: Synthetic Chimeric Antigen Receptor sequence
MALPVTALLLPLALLLHAARPGSEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7795 - protein, 563 aa, Artificial Sequence
  Description of Artificial Sequence: Synthetic Chimeric Antigen Receptor sequence
MKHLWFFLLLVAAPRWVLSQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLPMVTMSFDYWGQGTLVTVSRGGGGSGGGGSGGGGSMASYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSTRFWVLVVVGGVLACYSLLVTVAFIIFWVRLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWV

SEQ ID NO: 7796 - protein, 603 aa, Artificial Sequence
  Description of Artificial Sequence: Synthetic Chimeric Antigen Receptor sequence
MKHLWFFLLLVAAPRWVLSQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLPMVTMSFDYWGQGTLVTVSRGGGGSGGGGSGGGGSMASYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSTRFWVLVVVGGVLACYSLLVTVAFIIFWVRSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRSQCMWPRETQLLLEVPPSTEDARSCQFPEEERGERSAEEKGRLGDLWV

SEQ ID NO: 7797 - protein, 603 aa, Artificial Sequence [sequence omitted]

SEQ ID NO: 7798 - protein, 603 aa, Artificial Sequence [sequence omitted]

SEQ ID NO: 7799 - protein, 554 aa, Artificial Sequence
  Description of Artificial Sequence: Synthetic Chimeric Antigen Receptor sequence
MKHLWFFLLLVAAPRWVLSQVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLPMVTMSFDYWGQGTLVTVSRGGGGSGGGGSGGGGSMASYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSTRFWVLVVVGGVLACYSLLVTVAFIIFWVRSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7800 - protein, 490 aa, Artificial Sequence
  Description of Artificial Sequence: Synthetic Chimeric Antigen Receptor sequence
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7801 - protein, 484 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7802 - protein, 490 aa, Artificial Sequence
  Description of Artificial Sequence: Synthetic Chimeric Antigen Receptor sequence
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7803 - protein, 490 aa, Artificial Sequence
  Description of Artificial Sequence: Synthetic Chimeric Antigen Receptor sequence
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7804 - protein, 490 aa, Artificial Sequence
  Description of Artificial Sequence: Synthetic Chimeric Antigen Receptor sequence
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7805 - protein, 490 aa, Artificial Sequence
  Description of Artificial Sequence: Synthetic Chimeric Antigen Receptor sequence
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7806 - protein, 490 aa, Artificial Sequence
  Description of Artificial Sequence: Synthetic Chimeric Antigen Receptor sequence
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7807 - protein, 490 aa, Artificial Sequence
  Description of Artificial Sequence: Synthetic Chimeric Antigen Receptor sequence
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7808 - protein, 490 aa, Artificial Sequence
  Description of Artificial Sequence: Synthetic Chimeric Antigen Receptor sequence
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7809 - protein, 487 aa, Artificial Sequence
  Description of Artificial Sequence: Synthetic Chimeric Antigen Receptor sequence
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7810 - protein, 535 aa, Artificial Sequence; identical to SEQ ID NO: 7772
  Description of Artificial Sequence: Synthetic Chimeric Antigen Receptor sequence

SEQ ID NO: 7811 - protein, 461 aa, Artificial Sequence
  Description of Artificial Sequence: Synthetic Chimeric Antigen Receptor sequence
EVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSGGGGSGGGGSGGGGSDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7812 - protein, 647 aa, Artificial Sequence
  Description of Artificial Sequence: Synthetic Chimeric Antigen Receptor sequence
EVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSGGGGSGGGGSGGGGSDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7813 - protein, 464 aa, Artificial Sequence
  Description of Artificial Sequence: Synthetic Chimeric Antigen Receptor sequence
QVQLQQSGGGLVKPGASLKLSCVTSGFTFRKFGMSWVRQTSDKRLEWVASISTGGYNTYYSDNVKGRFTISRENAKNTLYLQMSSLKSEDTALYYCTRGYSSTSYAMDYWGQGTTVTVGGGGSGGGGSGGGGSDIELTQSPASLSVATGEKVTIRCMTSTDIDDDMNWYQQKPGEPPKFLISEGNTLRPGVPSRFSSSGTGTDFVFTIENTLSEDVGDYYCLQSFNVPLTFGDGTKLEKALTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7814 - protein, 650 aa, Artificial Sequence
  Description of Artificial Sequence: Synthetic Chimeric Antigen Receptor sequence
QVQLQQSGGGLVKPGASLKLSCVTSGFTFRKFGMSWVRQTSDKRLEWVASISTGGYNTYYSDNVKGRFTISRENAKNTLYLQMSSLKSEDTALYYCTRGYSSTSYAMDYWGQGTTVTVGGGGSGGGGSGGGGSDIELTQSPASLSVATGEKVTIRCMTSTDIDDDMNWYQQKPGEPPKFLISEGNTLRPGVPSRFSSSGTGTDFVFTIENTLSEDVGDYYCLQSFNVPLTFGDGTKLEKALEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7815 - protein, 482 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7816 - protein, 672 aa, Artificial Sequence [sequence omitted]

SEQ ID NO: 7817 - protein, 485 aa, Artificial Sequence
  Description of Artificial Sequence: Synthetic Chimeric Antigen Receptor sequence
MALPVTALLLPLALLLHAARPQVQLQQSGGGLVKPGASLKLSCVTSGFTFRKFGMSWVRQTSDKRLEWVASISTGGYNTYYSDNVKGRFTISRENAKNTLYLQMSSLKSEDTALYYCTRGYSSTSYAMDYWGQGTTVTVGGGGSGGGGSGGGGSDIELTQSPASLSVATGEKVTIRCMTSTDIDDDMNWYQQKPGEPPKFLISEGNTLRPGVPSRFSSSGTGTDFVFTIENTLSEDVGDYYCLQSFNVPLTFGDGTKLEKALTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7818 - protein, 675 aa, Artificial Sequence [sequence omitted]

SEQ ID NO: 7819 - protein, 457 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 7820 - protein, 439 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSKRDHHHHHHQDKKTMMMNEEDDGNGMDELLAVLGYKVRSSEMADVAQKLEQLEVMMSNVQEDDLSQLATETVHYNPAELYTWLDSMLTDLN

SEQ ID NO: 7821 - protein, 692 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 7822 - protein, 567 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVRVSSTTTPAPRPPTPAPTIASQPLSLRPEACRPAAGGAVHTRGLDFACDIYIWAPLAGTCGVLLLSLVITLYCKRGRKKLLGGGGSGGGGSSNSYDSSSIKVLKGLDAVRKRPGMYIGDTDDGTGLHHMVFEVVDNAIDEALAGHCKEIIVTIHADNSVSVQDDGRGIPTGIHPEEGVSAAEVIMTVLHAGGKFDDNSYKVSGGLHGVGVSVVNALSQKLELVIQREGKIHRQIYEHGVPQAPLAVTGETEKTGTMVRFWPSLETFTNVTEFEYEILAKRLRELSFLNSGVSIRLRDKRDGKEDHFHYEG

SEQ ID NO: 7823 - protein, 456 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSKRGRKKLLGGGGSGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSTTTPAPRPPTPAPTIASQPLSLRPEACRPAAGGAVHTRGLDFACDIYIWAPLAGTCGVLLLSLVITLYC

SEQ ID NO: 7824 - protein, 446 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNVADSVKGRFTISRDNSKNTLVLQMNSLRAEDTAVYYCAGSSGWSEYWGQGTLVTVSSKRGRKKLLGGGGSGGGGSASRILWHEMWHEGLEEASRLYFGERNVKGMFEVLEPLHAMMERGPQTLKETSFNQAYGRDLMEAQEWCRKYMKSGNVKDLLQAWDLYYHVFRRISKTSTTTPAPRPPTPAPTIASQPLSLRPEACRPAAGGAVHTRGLDFACDIYIWAPLAGTCGVLLLSLVITLYC

SEQ ID NO: 7825 - protein, 446 aa, Artificial Sequence
  Description of Artificial Sequence: Synthetic Chimeric Antigen Receptor sequence
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLGGGGSGGGGSASRILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 7826 - protein, 548 aa, Artificial Sequence
  Description of Artificial Sequence: Synthetic Chimeric Antigen Receptor sequence
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7827 - protein, 484 aa, Artificial Sequence
  Description of Artificial Sequence: Synthetic Chimeric Antigen Receptor sequence
MVLLVTSLLLCELPHPAFLLIPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7828 - protein, 491 aa, Artificial Sequence; identical to SEQ ID NO: 7794
  Description of Artificial Sequence: Synthetic Chimeric Antigen Receptor sequence

SEQ ID NO: 7829 - protein, 490 aa, Artificial Sequence; identical to SEQ ID NO: 7803
  Description of Artificial Sequence: Synthetic Chimeric Antigen Receptor sequence

SEQ ID NO: 7830 - protein, 490 aa, Artificial Sequence; identical to SEQ ID NO: 7804
  Description of Artificial Sequence: Synthetic Chimeric Antigen Receptor sequence

SEQ ID NO: 7831 - protein, 490 aa, Artificial Sequence
  Description of Artificial Sequence: Synthetic Chimeric Antigen Receptor sequence
MALPVTALLLPLALLLHAARPEIQLVQSSAEVKKPSATVKISCKSSSFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7832 - protein, 490 aa, Artificial Sequence; identical to SEQ ID NO: 7806
  Description of Artificial Sequence: Synthetic Chimeric Antigen Receptor sequence

SEQ ID NO: 7833 - protein, 490 aa, Artificial Sequence; identical to SEQ ID NO: 7807
  Description of Artificial Sequence: Synthetic Chimeric Antigen Receptor sequence

SEQ ID NO: 7834 - protein, 491 aa, Artificial Sequence
  Description of Artificial Sequence: Synthetic Chimeric Antigen Receptor sequence
MALPVTALLLPLALLLHAARPDVVMTQSPLSLPVTLGQPASISCKSSCISLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7835 - protein, 490 aa, Artificial Sequence; identical to SEQ ID NO: 7808
  Description of Artificial Sequence: Synthetic Chimeric Antigen Receptor sequence

SEQ ID NO: 7836 - protein, 484 aa, Artificial Sequence; identical to SEQ ID NO: 7801
  Description of Artificial Sequence: Synthetic Chimeric Antigen Receptor sequence

SEQ ID NO: 7837 - protein, 490 aa, Artificial Sequence; identical to SEQ ID NO: 7802
  Description of Artificial Sequence: Synthetic Chimeric Antigen Receptor sequence

SEQ ID NO: 7838 - protein, 490 aa, Artificial Sequence; identical to SEQ ID NO: 7803
  Description of Artificial Sequence: Synthetic Chimeric Antigen Receptor sequence

SEQ ID NO: 7839 - protein, 490 aa, Artificial Sequence; identical to SEQ ID NO: 7804
  Description of Artificial Sequence: Synthetic Chimeric Antigen Receptor sequence

SEQ ID NO: 7840 - protein, 490 aa, Artificial Sequence; identical to SEQ ID NO: 7805
  Description of Artificial Sequence: Synthetic Chimeric Antigen Receptor sequence

SEQ ID NO: 7841 - protein, 490 aa, Artificial Sequence; identical to SEQ ID NO: 7806
  Description of Artificial Sequence: Synthetic Chimeric Antigen Receptor sequence

SEQ ID NO: 7842 - protein, 490 aa, Artificial Sequence; identical to SEQ ID NO: 7807
  Description of Artificial Sequence: Synthetic Chimeric Antigen Receptor sequence

SEQ ID NO: 7843 - protein, 490 aa, Artificial Sequence; identical to SEQ ID NO: 7808
  Description of Artificial Sequence: Synthetic Chimeric Antigen Receptor sequence

SEQ ID NO: 7844 - protein, 487 aa, Artificial Sequence; identical to SEQ ID NO: 7809
  Description of Artificial Sequence: Synthetic Chimeric Antigen Receptor sequence

SEQ ID NO: 7845 - protein, 548 aa, Artificial Sequence; identical to SEQ ID NO: 7826
  Description of Artificial Sequence: Synthetic Chimeric Antigen Receptor sequence

SEQ ID NO: 7846 - protein, 484 aa, Artificial Sequence; identical to SEQ ID NO: 7827
  Description of Artificial Sequence: Synthetic Chimeric Antigen Receptor sequence

SEQ ID NO: 7847 - protein, 491 aa, Artificial Sequence; identical to SEQ ID NO: 7794
  Description of Artificial Sequence: Synthetic Chimeric Antigen Receptor sequence

SEQ ID NO: 7848 - protein, 535 aa, Artificial Sequence; identical to SEQ ID NO: 7772
  Description of Artificial Sequence: Synthetic Chimeric Antigen Receptor sequence

SEQ ID NO: 7849 - protein, 243 aa, Artificial Sequence; identical to SEQ ID NO: 6158
  Description of Artificial Sequence: Synthetic Chimeric Antigen Receptor sequence

SEQ ID NO: 7850 - protein, 240 aa, Artificial Sequence; identical to SEQ ID NO: 6128
  Description of Artificial Sequence: Synthetic Chimeric Antigen Receptor sequence

SEQ ID NO: 7851 - protein, 1347 aa, Artificial Sequence
  Description of Artificial Sequence: Synthetic Chimeric Antigen Receptor sequence
QVQLVESGPGVVQPGRSLRISCAVSGFSVTNYGVHWVRQPPGKGLEWLGVRWAGGITNYNSAFMSRLTISKDNSKNTVYLQMNSLRAEDTAMYYCASRGGHYGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGSTSGSGKPGSSEGSTKGFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 7852 - protein, 504 aa, Artificial Sequence
  Description of Artificial Sequence: Synthetic Chimeric Antigen Receptor sequence
MALPVTALLLPLALLLHAARPGSSRAAQPAMAQVQLQQSGAELVKPGASVKISCKASGYSFTGYFMNWVKQSHGKSLEWIGRIHPYDGDTFYNQNFKDKATLTVDKSSNTAHMELLSLTSEDFAVYYCTRYDGSRAMDYWGQGTTVTVSSGGGGSGGGGSGGGGSDIELTQSPASLAVSLGQRAIISCKASQSVSFAGTSLMHWYHQKPGQQPKLLIYRASNLEAGVPTRFSGSGSKTDFTLNIHPVEEEDAATYYCQQSREYPYTFGGGTKLEIKRAAASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7853 - protein, 491 aa, Artificial Sequence
  Description of Artificial Sequence: Synthetic Chimeric Antigen Receptor sequence
MALPVTALLLPLALLLHAARPGSQLVESGGGLVQPGRSLRLSCTTSGFTFGDYAMIWARQAPGKGLEWVSSISSSSSYIYYADSVKGRFTISRDNAKNSLYLQMNSLRAEDTAVYYCARERYDFWSGMDVWGKGTTVTVSSGGGGSGGGGSGGSAQSALTQPASVSGSPGQSITISCTGTSSDVGSYNLVSWYQQHPGKAPKLMIYEGSKRPSGVSNRFSGSKSGNAASLTISGLQAEDEADYYCQSYDSSLSVVFGGGTKLTVLGASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7854 - protein, 504 aa, Artificial Sequence; identical to SEQ ID NO: 7852
  Description of Artificial Sequence: Synthetic Chimeric Antigen Receptor sequence

SEQ ID NO: 7855 - protein, 491 aa, Artificial Sequence; identical to SEQ ID NO: 7853
  Description of Artificial Sequence: Synthetic Chimeric Antigen Receptor sequence

SEQ ID NO: 7856 - protein, 450 aa, Artificial Sequence
  Description of Artificial Sequence: Synthetic Chimeric Antigen Receptor sequence
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDNLRSYYASWYRQKSGQAPVLVIYGKNNRPSGIPDRFSGSSSGNTASLTITAAQAEDEADYYCHSRKSRGNHLLFGGGTKLTVLGQASTTTPAPRPPTPAPTIASQPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7857 - protein, 496 aa, Artificial Sequence
  Description of Artificial Sequence: Synthetic Chimeric Antigen Receptor sequence
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDNLRSYYASWYRQKSGQAPVLVIYGKNNRPSGIPDRFSGSSSGNTASLTITAAQAEDEADYYCHSRKSRGNHLLFGGGTKLTVLGQASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSIDRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7858 - protein, 450 aa, Artificial Sequence
  Description of Artificial Sequence: Synthetic Chimeric Antigen Receptor sequence
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7859 - protein, 498 aa, Artificial Sequence
  Description of Artificial Sequence: Synthetic Chimeric Antigen Receptor sequence
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDIYIWAPLAGTCGVLLLSLVITLYCRVRKYRSNKGESPVEPAEPCRYSCPREEEGSTIPIQEDYRKPEPACSPRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7860 - protein, 496 aa, Artificial Sequence
  Description of Artificial Sequence: Synthetic Chimeric Antigen Receptor sequence
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSIDRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7861 - protein, 492 aa, Artificial Sequence
  Description of Artificial Sequence: Synthetic Chimeric Antigen Receptor sequence
MALPVTALLLPLALLLHAARPGSAEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGGSGGGGSGGGGSSSELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQASTTTPAPRPPTPAPTIASQPLSLRPEACRPAAGGAVHTRGLDFACDIYIWAPLAGTCGVLLLSLVITLYCRVGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7862 - protein, 466 aa, Artificial Sequence
  Description of Artificial Sequence: Synthetic Chimeric Antigen Receptor sequence
DAVVTQESALTSSPGETVTLTCRSSTGAVTISNVASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDVGVNWVRQSPGKGLEWLGVIWGDGITDYNSALKSRLSVTKDNSKSQVFLKMNSLQSGDSARVYCVTGLFDYWGQGTTLTVSSTTTPAPRPPTPAPTIASQPLSLRPEACRPAAGGAVHTRGLDFACDIYIWAPLAGTCGVLLLSLVITLVCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 7863 - protein, 434 aa, Artificial Sequence
  Description of Artificial Sequence: Synthetic Chimeric Antigen Receptor sequence
DAVVTQESALTSSPGETVTLTCRSSTGAVTISNVASWVQEKPDHLFTGLIGGTNNRAPGVPARFSGSLIGDKAALTITGAQTEDEAIYFCVLWYSDHWVFGGGTKLTVLGGGGGSGGGGSGGGGSGGGGSDVQLQESGPGLVAPSQSLSITCTVSGFLLTDVGVNWVRQSPGKGLEWLGVIWGDGITDYNSALKSRLSVTKDNSKSQVFLKMNSLQSGDSARYVCVTGLFDYWGQGTTLTVSSESKVGPPCPPCPDIYIWAPLAGTCGVLLLSLVITLVCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 7864 - protein, 719 aa, Artificial Sequence
  Description of Artificial Sequence: Synthetic Chimeric Antigen Receptor sequence
METDTLLLWVLLLWVPGSTGQVQLKESGPVLVAPSQTLSITCTVSGFSLASYNIHWVRQPPGKGLEWLGVIWAGGSTNYNSALMSRLSISKDNSKSQVFLQMNSLQTDDTAMYYCAKRSDDYSWFAYWGQGTLVTVSASGGGGSGGGGSGGGGSENVLTQSPAIMSASPGEKVTMTCRASSSVSSSYLHWYQQKSGASPKVWIYSTSNLASGVPGRFSGSGSGTSYSLTISSVEAEDAATYYCQQYSGYPITFGAGTKVEVKRSDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7865 - protein, 718 aa, Artificial Sequence
  Description of Artificial Sequence: Synthetic Chimeric Antigen Receptor sequence
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7866 - protein, 717 aa, Artificial Sequence
  Description of Artificial Sequence: Synthetic Chimeric Antigen Receptor sequence
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7867 - protein, 527 aa, Artificial Sequence
  Description of Artificial Sequence: Synthetic Chimeric Antigen Receptor sequence
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPTTTPAPRPPTPAPTIASQPLSLRPEACRPAAGGAVHTRGLDFACDIFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7868 - protein, 527 aa, Artificial Sequence; identical to SEQ ID NO: 7867
  Description of Artificial Sequence: Synthetic Chimeric Antigen Receptor sequence

SEQ ID NO: 7869 - protein, 501 aa, Artificial Sequence
  Description of Artificial Sequence: Synthetic Chimeric Antigen Receptor sequence
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPKDPKFWVLVVVGGVLACYSLLVTVAFIIFWVRSKRSRLLHSDYMNMTPRRPGPTRKHYQPYAPPRDFAAYRSRDQRLPPDAHKPPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7870 - protein, 642 aa, Artificial Sequence
  Description of Artificial Sequence: Synthetic Chimeric Antigen Receptor sequence
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7871 - protein, 681 aa, Artificial Sequence
  Description of Artificial Sequence: Synthetic Chimeric Antigen Receptor sequence
METDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7872 - protein, 1103 aa, Artificial Sequence
  Description of Artificial Sequence: Synthetic Chimeric Antigen Receptor sequence
MLEGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESGGGSGVDGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSASRAEGRGSLLTCGDVEENPGPMETDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7873 - protein, 858 aa, Artificial Sequence
  Description of Artificial Sequence: Synthetic Chimeric Antigen Receptor sequence
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVVRAEGRGSLLTCGDVEENPGPMETDTLLLWVLLLWVPGSTGQVQLQESGPGLVKPSQTLSITCTVSGFSLASYNIHWVRQPPGKGLEWLGVIWAGGSTNYNSALMSRLTISKDNSKNQVFLKMSSLTAADTAVYYCAKRSDDYSWFAYWGQGTLVTVSSGGGGSGGGGSGGGGSENQMTQSPSSLSASVGDRVTMTCRASSSVSSSYLHWYQQKSGKAPKVWIYSTSNLASGVPSRFSGSGSGTDYTLTISSLQPEDFATYYCQQYSGYPITFGQGTKVEIKRSDPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7874 - protein, 402 aa, Artificial Sequence
  Description of Artificial Sequence: Synthetic Chimeric Antigen Receptor sequence
MLEGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESGGGSGVDGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSAS

SEQ ID NO: 7875 - protein, 157 aa, Artificial Sequence
  Description of Artificial Sequence: Synthetic Chimeric Antigen Receptor sequence
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 7876 - protein, 422 aa, Artificial Sequence
  Description of Artificial Sequence: Synthetic Chimeric Antigen Receptor sequence
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7877 - protein, 892 aa, Artificial Sequence
  Description of Artificial Sequence: Synthetic Chimeric Antigen Receptor sequence
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGSTSGSGKPGSSEGSTKGEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 7878 - protein, 900 aa, Artificial Sequence
  Description of Artificial Sequence: Synthetic Chimeric Antigen Receptor sequence
EVKLVESGGGLVLPGDSLRLSCATSEFTFTDYYMTWVRQPPRKALEWLGFIRNRANGYTTEYNPSVKGRFTISRDNSQSILYLQMNTLRTEDSATYYCARVSNWAFDYWGQGTTLTVSSGSTSGSGKPGSSEGSTKGDVVMTQTPLSLPVSLGDQASISCRSSQSLLKNNGNTFLHWYLQKSGQSPKLLIYKVSNRLSGVPDRFSGSGSGTYFTLKISRVEAEDLGVYFCSQSTHIPYTFGGGTKLEIKFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 7879 - protein, 895 aa, Artificial Sequence
  Description of Artificial Sequence: Synthetic Chimeric Antigen Receptor sequence
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGSTSGSGKPGSSEGSTKGDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKFWVLVVVGGVLACYSLLVTVAFIIFWVKRGRKKLLYIFKQPFMRPVQTTQEEDGCSCRFPEEEEGGCELQRRKYRSNKGESPVEPAEPCHYSCPREEEGSTIPIQEDYRKPEPACSPGSTSGSGKPGSSEGSTKGRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSTSGSGKPGSSEGSTKGVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTSMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 7880 - protein, 456 aa, Artificial Sequence
  Description of Artificial Sequence: Synthetic Chimeric Antigen Receptor sequence
MALPVTALLLPLALLLHAARPDVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVGGGGSGGGGSGGGGSDIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPP

SEQ ID NO: 7881 - protein, 486 aa, Artificial Sequence
  Description of Artificial Sequence: Synthetic Chimeric Antigen Receptor sequence
MALPVTALLLPLALLLHAARPDVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVGGGGSGGGGSGGGGSDIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7882 - protein, 672 aa, Artificial Sequence
  Description of Artificial Sequence: Synthetic Chimeric Antigen Receptor sequence
MALPVTALLLPLALLLHAARPDVQLVESGGGLVQPGGSRKLSCAASGFTFSNFGMHWVRQAPEKGLEWVAYISSGGSSINYADTVKGRFTISRDNPKNTLFLQMTSLRSEDTAIYYCTRGGTGTRSLYYFDYWGQGATLIVGGGGSGGGGSGGGGSDIQMTQITSSLSVSLGDRVIISCRASQDIGNFLNWYQQKPDGSLKLLIYYTSRLQSGVPSRFSGWGSGTDYSLTISNLEEEDIATFFCQQGKTLPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7883 - protein, 459 aa, Artificial Sequence
  Description of Artificial Sequence: Synthetic Chimeric Antigen Receptor sequence
MALPVTALLLPLALLLHAARPEVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSSGGGGSGGGGSGGGGSDIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7884 - protein, 488 aa, Artificial Sequence
  Description of Artificial Sequence: Synthetic Chimeric Antigen Receptor sequence
MALPVTALLLPLALLLHAARPEVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSSGGGGSGGGGSGGGGSDIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7885 - protein, 674 aa, Artificial Sequence
  Description of Artificial Sequence: Synthetic Chimeric Antigen Receptor sequence
MALPVTALLLPLALLLHAARPEVVVVESGGGFVKPGGSLKLSCAAAGFTFSRYAMSWVRQTPEKRLEWVATISSGGSHTYYPDSVKGRFTISRDNAKNTLYLQMSSLRSEDTAIYYCARPGYDRGAWFFDVWGAGTTVTVSSGGGGSGGGGSGGGGSDIVLTQSPATLSVTPGDSVSLSCRASQIISNNLHWYQQKSHESPRLLIKYASQSISGIPSRFSGSGSGTDFTLSINSVETEDFGMYFCQQSNSWPLTFGSGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7886 - protein, 456 aa, Artificial Sequence
  Description of Artificial Sequence: Synthetic Chimeric Antigen Receptor sequence
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7887 - protein, 485 aa, Artificial Sequence
  Description of Artificial Sequence: Synthetic Chimeric Antigen Receptor sequence
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7888 - protein, 671 aa, Artificial Sequence
  Description of Artificial Sequence: Synthetic Chimeric Antigen Receptor sequence
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7889 - protein, 454 aa, Artificial Sequence
  Description of Artificial Sequence: Synthetic Chimeric Antigen Receptor sequence
MALPVTALLLPLALLLHAARPQVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSSGGGGSGGGGSGGGGSDIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEIGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7890 - protein, 483 aa, Artificial Sequence
  Description of Artificial Sequence: Synthetic Chimeric Antigen Receptor sequence
MALPVTALLLPLALLLHAARPQVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSSGGGGSGGGGSGGGGSDIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7891 - protein, 669 aa, Artificial Sequence
  Description of Artificial Sequence: Synthetic Chimeric Antigen Receptor sequence
MALPVTALLLPLALLLHAARPQVQLQQSGGGLVKPGGSLTLSCAASRFTFSTYAMSWVRQTPAKRLEWVAYISSGGASTYYRDSVKGRFTISRDNAKNTLYLQMSSLRSEDTAMYYCARGGSRYAMDYWGQGTTVTVSSGGGGSGGGGSGGGGSDIQLTQSPAILSVSPGERVSFSCWASQSIGTSIHWYQQRTNGSPRLLIKYSSESISGIPSRFSGSGSGTDFTLSINSLESEDIADYYCQQTYSWPFTFGSGTKLEIEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7892 - protein, 415 aa, Artificial Sequence
  Description of Artificial Sequence: Synthetic Chimeric Antigen Receptor sequence
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7893 - protein, 396 aa, Artificial Sequence
  Description of Artificial Sequence: Synthetic Chimeric Antigen Receptor sequence
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7894 - protein, 459 aa, Artificial Sequence
  Description of Artificial Sequence: Synthetic Chimeric Antigen Receptor sequence
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7895 - protein, 440 aa, Artificial Sequence
  Description of Artificial Sequence: Synthetic Chimeric Antigen Receptor sequence
QVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7896 - protein, 457 aa, Artificial Sequence
  Description of Artificial Sequence: Synthetic Chimeric Antigen Receptor sequence
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7897 - protein, 457 aa, Artificial Sequence; identical to SEQ ID NO: 7896
  Description of Artificial Sequence: Synthetic Chimeric Antigen Receptor sequence

SEQ ID NO: 7898 - DNA, 1380 bp, Artificial Sequence
  Description of Artificial Sequence: Synthetic Chimeric Antigen Receptor sequence
atggattggatttggcgcattctgtttctggtgggagccgcaaccggagcacatagtcaggtccagctgcagcagtcaggagccgaactggtgcggcccggcgcaagtgtcaaactgtcatgcaaggccagcgggtataccttcacagactacgagatgcactgggtgaaacagacccctgtgcacggcctgaagtggatcggcgctctggacccaaaaaccggggatacagcatattcccagaagtttaaaggaaaggccactctgaccgctgacaagagctcctctactgcctacatggagctgaggagcctgacatccgaagatagcgccgtgtactattgcacccgcttctactcctatacatactggggccaggggactctggtgaccgtctctgcaggaggaggaggctctggaggaggagggagtggaggcgggggaagcgacgtggtcatgacacagactccactgtccctgcccgtgagcctgggcgatcaggctagcatttcctgtcgaagttcacagagtctggtgcactcaaacggaaatacctatctgcattggtacctgcagaagccaggccagtctcccaaactgctgatctataaggtgagcaaccggttctccggggtccctgacagattttctggaagtggctcagggacagatttcactctgaaaattagcagagtggaggccgaagatctgggcgtctacttttgtagccagaatacccacgtcccaccaacattcggaagcggcactaaactggaaatcaaggagcccaaatcttgtgacaaaactcacacatgcccaccgtgcccggatccgaaagatcccaaattttgggtgctggtggtggttggtggagtcctggcttgctatagcttgctagtaacagtggcctttattattaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 7899 - protein, 486 aa, Artificial Sequence
  Description of Artificial Sequence: Synthetic Chimeric Antigen Receptor sequence
MDWIWRILFLVGAATGAHSVLSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSKRGRKKLLYIFKPFMRPVTTEEDGCSCRFPEEEEGGCELRVKFSRSADAPAYGNLYNELNLGRREEYDVLDKRRGRDPEMGGKPRRKNPEGLYNELKDKMAEAYSEIGMKGERRRGKGHDGLYGLSTATKDTYDALHMALPPR

SEQ ID NO: 7900 - protein, 501 aa, Artificial Sequence
  Description of Artificial Sequence: Synthetic Chimeric Antigen Receptor sequence
MDWIWRILFLVGAATGAHSQVQLQQSGAELVRPGASVKLSCKASGYTFTDYEMHWVKQTPVHGLKWIGALDPKTGDTAYSQKFKGKATLTADKSSSTAYMELRSLTSEDSAVYYCTRFYSYTYWGQGTLVTVSAGGGGSGGGGSGGGGSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTHVPPTFGSGTKLEIKEPKSCDKTHTCPPCPDPKFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7901 - protein, 692 aa, Artificial Sequence; identical to SEQ ID NO: 7638
  Description of Artificial Sequence: Synthetic Chimeric Antigen Receptor sequence

SEQ ID NO: 7902 - protein, 464 aa, Artificial Sequence
  Description of Artificial Sequence: Synthetic Chimeric Antigen Receptor sequence
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7903 - protein, 469 aa, Artificial Sequence
  Description of Artificial Sequence: Synthetic Chimeric Antigen Receptor sequence
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7904 - protein, 511 aa, Artificial Sequence
  Description of Artificial Sequence: Synthetic Chimeric Antigen Receptor sequence
DVVMTQSPLSLPVTPGEPASISCRSSQSLVHSNANTYLHWYLQKPGQSPQLLIYKVSNRFSGVPDRFSGSGSGTDFTLKISRVEAEDVGVYYCSQNTHVPPTFGQGTKLEIKRGGGGSGGGGSGGGGSQVQLVQSGAEVKKPGASVKVSCKASGYTFTDYEMHWVRQAPGQGLEWMGALDPKTGDTAYSQKFKGRVTLTADESTSTAYMELSSLRSEDTAVYYCTRFYSYTYWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7905 - protein, 500 aa, Artificial Sequence
  Description of Artificial Sequence: Synthetic Chimeric Antigen Receptor sequence
DIQMTQSPSSLSASVGDRVTITCRASQNIATDVSTAVAWIQQKPGKAPKLLIYSASFLYSGVPSRFSGSGSGTDFTLTISSLQPEDFATYYCQQSEPEPYTFGQGTKVEIKRGSTSGSGKPGSGEGSTKGEVQLVESGGGLVQPGGSLRLSCAASGFTLSGDWVIHWVRQAPGKGLEWVGEISAAGGYTDYADSVKGRFTISADTSKNTAYLQMNSLRAEDTAVYYCARESRVSFEAAMDYWGQGTLVPSDIAVEWESNGQPENNYKTTPPVLDSDGSFFLYSRLTVDKSRWQEGNVFSCSVMHEALHNHYTQKSLSLSLGKWVLVVVGGVLACYSLLVTVAFIIKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7906 - protein, 503 aa, Artificial Sequence
  Description of Artificial Sequence: Synthetic Chimeric Antigen Receptor sequence
DIQMTQSPSSLSASVGDRVTITCRASQNIATDVSTAVAWIQQKPGKAPKLLIYSASFLYSGVPSRFSGSGSGTDFTLTISSLQPEDFATYYCQQSEPEPYTFGQGTKVEIKRGSTSGSGKPGSGEGSTKGEVQLVESGGGLVQPGGSLRLSCAASGFTLSGDWVIHWVRQAPGKGLEWVGEISAAGGYTDYADSVKGRFTISADTSKNTAYLQMNSLRAEDTAVYYCARESRVSFEAAMDYWGQGTLVPSDIAVEWESNGQPENNYKTTPPVLDSDGSFFLYSRLTVDKSRWQEGNVFSCSVMHEALHNHYTQKSLSLSLGKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7907 - protein, 818 aa, Artificial Sequence
  Description of Artificial Sequence: Synthetic Chimeric Antigen Receptor sequence
MLLLVTSLLLCELPHPAFLLIPEVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPDIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7908 - protein, 1162 aa, Artificial Sequence
  Description of Artificial Sequence: Synthetic Chimeric Antigen Receptor sequence
MLLLVTSLLLCELPHPAFLLIPEVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRGGSTSEGRGSLLTCGDVEENPGPMETDTLLLWVLLLWVPGSTGDIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7909 - protein, 816 aa, Artificial Sequence
  Description of Artificial Sequence: Synthetic Chimeric Antigen Receptor sequence
MLLLVTSLLLCELPHPAFLLIPDIQMTQSPILLSASVGDRVTITCRASQDVNTAVAWYQQRTNGSPRLLIYSASFLYSGVPSRFSGSRSGTDFTLTISSLQPEDEADYYCQQHYTTPPTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECLEGGGEGRGSLLTCGDVEENPGMLLLVTSLLLCELPHPAFLLIPEVQLVESGGGLVQPGGSLRLSCAASGFNIKDTYIHWVRQSPGKGLEWVARIYPTNGYTRYADSVKGRFTISADTSKNTAYLQMNSLRAEDTAIYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7910 - protein, 818 aa, Artificial Sequence; identical to SEQ ID NO: 7907
  Description of Artificial Sequence: Synthetic Chimeric Antigen Receptor sequence

SEQ ID NO: 7911 - protein, 470 aa, Artificial Sequence
  Description of Artificial Sequence: Synthetic Chimeric Antigen Receptor sequence
DIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVVYCSRWGGDGFYAMDYWGQGTLVTVSSAAATTTPAPRPPTPAPTIASQPLSLRPEACRPAAGGAVHTRGLDFACDIYIWAPLAGTCGVLLLSLVITLVCKRGRKKLLYIFKQPFMRPVQTIQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 7912 - protein, 438 aa, Artificial Sequence
  Description of Artificial Sequence: Synthetic Chimeric Antigen Receptor sequence
DIQMTQSPSSLSASVGDRVTITCRASQDVNTAVAWYQQKPGKAPKLLIVSASFLVSGVPSRFSGSRSGTDFTLTISSLQPEDFATYVCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVVYCSRWGGDGFYAMDYWGQGTLVTVSSAAAESKVGPPCPPCPDIYIWAPLAGTCGVLLLSLVITLVCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAVSEIGMKGERRRGKGHDGLYQGLSTATKDTYDALHMQALPPR

SEQ ID NO: 7913 - protein, 470 aa, Artificial Sequence
  Description of Artificial Sequence: Synthetic Chimeric Antigen Receptor sequence
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7914 - protein, 438 aa, Artificial Sequence
  Description of Artificial Sequence: Synthetic Chimeric Antigen Receptor sequence
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAAAESKYGPPCPPCPDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7915 - protein, 470 aa, Artificial Sequence; identical to SEQ ID NO: 7913
  Description of Artificial Sequence: Synthetic Chimeric Antigen Receptor sequence

SEQ ID NO: 7916 - protein, 438 aa, Artificial Sequence; identical to SEQ ID NO: 7914
  Description of Artificial Sequence: Synthetic Chimeric Antigen Receptor sequence

SEQ ID NO: 7917 - protein, 680 aa, Artificial Sequence
  Description of Artificial Sequence: Synthetic Chimeric Antigen Receptor sequence
MLLLVTSLLLCELPHPAFLLIPMAQVKLQQSGPDLVKPGASVKISCKASGYSFTGYYMHWVKQSHGKSLEWIGRVNPNSGGTSYNQKFKDKAILTVDKSSSTAYMELRSLTSEDSAVYYCARSKGNYFYAMDYWGQGTTVTVSSSGGGSGGGGSGGGGSDIELTQSPSSLAVSLGQRATISCRASESVDSHGTSLMHWYQQKPGQPPKFLIYRASNLESGIPARFSGSGSRTDFTLTINPVETDDVAIYYCQQSNEDPPTFGGGTKLELKESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7918 - protein, 606 aa, Artificial Sequence
  Description of Artificial Sequence: Synthetic Chimeric Antigen Receptor sequence
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFNPRKPTTTPAPRPPTPAPTIASQPLSLRPEACRPAAGGAVHTRGLDFAQLLCYLLDGILFIYGVILTALFLRVVTFWVRSKRSRLLHSDYMNMTPRRPGPTRKHYQPYAPPRDFAAYRSTRKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRQPAAAEGRGSLLTCGDVEENPGPMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVKILIPCHRVVCSSGAVGNYSGGLAVKEWLLAHEGHRLGKPGLGGSSGLAGAWLKGAGATSGSPPAGRN

SEQ ID NO: 7919 - protein, 692 aa, Artificial Sequence; identical to SEQ ID NO: 7638
  Description of Artificial Sequence: Synthetic Chimeric Antigen Receptor sequence

SEQ ID NO: 7920 - protein, 380 aa, Artificial Sequence [sequence omitted]

SEQ ID NO: 7921 - protein, 362 aa, Artificial Sequence
  Description of Artificial Sequence: Synthetic Chimeric Antigen Receptor sequence
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRD

SEQ ID NO: 7922 - protein, 354 aa, Artificial Sequence
  Description of Artificial Sequence: Synthetic Chimeric Antigen Receptor sequence
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 7923 - protein, 330 aa, Artificial Sequence
  Description of Artificial Sequence: Synthetic Chimeric Antigen Receptor sequence
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 7924 - protein, 717 aa, Artificial Sequence [sequence omitted]

SEQ ID NO: 7925 - protein, 457 aa, Artificial Sequence
  Description of Artificial Sequence: Synthetic Chimeric Antigen Receptor sequence
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7926 - protein, 460 aa, Artificial Sequence
  Description of Artificial Sequence: Synthetic Chimeric Antigen Receptor sequence
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7927 - protein, 486 aa, Artificial Sequence
  Description of Artificial Sequence: Synthetic Chimeric Antigen Receptor sequence
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7928 - protein, 489 aa, Artificial Sequence
  Description of Artificial Sequence: Synthetic Chimeric Antigen Receptor sequence
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7929 - protein, 672 aa, Artificial Sequence
  Description of Artificial Sequence: Synthetic Chimeric Antigen Receptor sequence
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7930 - protein, 675 aa, Artificial Sequence
  Description of Artificial Sequence: Synthetic Chimeric Antigen Receptor sequence
MALPVTALLLPLALLLHAARPEVKLQESGPGLVAPSQSLSFTCTVSGFSLSRNSVHWVRQPPGKGLEWLGMIWGGGSTDYNSALKSRLNISKDSSKSQVFLKMNSLQTDDTAMYFCARNGGYDVFHYWGQGTTVTVSSGGGGSGGGGSGGGGSQAVVTQESALTTSPGETVTLTCRSSTGAVTTSNYANWVQEKPDHLFTGLIGGTNNRAPGVPARFSGSLIGDKAALTITGAQTEDEAIYFCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7931 - protein, 457 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7932 - protein, 460 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7933 - protein, 486 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7934 - protein, 489 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7935 - protein, 672 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7936 - protein, 675 aa, Artificial Sequence
  Description of Artificial Sequence: Synthetic Chimeric Antigen Receptor sequence
MALPVTALLLPLALLLHAARPEVQLVESGGGLVQPGGSLRLSCAASGFSLSRNSVHWVRQAPGKGLEWLGMIWGGGSTDYNSALKSRFTISRDNSKNTLYLQMNSLRAEDTAVYYCARNGGYDVFHYWGQGTTVTVSSGGGGSGGGGSGGGGSQAVVTQEPSLTVSPGGTVTLTCRSSTGAVTTSNYANWVQQKPGQAPRGLIGGTNNRAPWTPARFSGSLLGGKAALTLSGVQPEDEAEYYCALWYSNHLVFGGGTKLTVLGEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7937 - protein, 180 aa, Artificial Sequence; identical to SEQ ID NO: 6696
  Description of Artificial Sequence: Synthetic Chimeric Antigen Receptor sequence

SEQ ID NO: 7938 - protein, 606 aa, Artificial Sequence
  Description of Artificial Sequence: Synthetic Chimeric Antigen Receptor sequence
MHPLLNPLLLALGLMALLLTTVIALTCLGGFASPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFNPRKPTTTPAPRPPTPAPTIASQPLSLRPEACRPAAGGAVHTRGLDFAQLLCYLLDGILFIYGVILTALFLRVVTFWVRSKRSRLLHSDYMNMTPRRPGPTRKHYQPYAPPRDFAAYRSTRKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRQPAAAEGRGSLLTCGDVEENPGPMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVKILIPCHRVVCSSGAVGNYSGGLAVKEWLLAHEGHRLGKPGLGGSSGLAGAWLKGAGATSGSPPAGRN

SEQ ID NO: 7939 - protein, 606 aa, Artificial Sequence
  Description of Artificial Sequence: Synthetic Chimeric Antigen Receptor sequence
MHPLLNPLLLALGLMALLLTTVIALTCLGGFASPGPVPPSTALRKLIEELVNITQNQKAPLCNGSMVWSINLTAGMYCAALESLINVSGCSAIEKTQRMLSGFCPHKVSAGQFSSLHVRDTKIEVAQFVKDLLLHLKKLFKEGQFNPRKPTTTPAPRPPTPAPTIASQPLSLRPEACRPAAGGAVHTRGLDFAQLLCYLLDGILFIYGVILTALFLRVVTFWVRSKRSRLLHSDYMNMTPRRPGPTRKHYQPYAPPRDFAAYRSTRKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRQPAAAEGRGSLLTCGDVEENPGPMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVKILIPCHRVVCSSGAVGNYSGGLAVKEWLLAHEGHRLGKPGLGGSSGLAGAWLKGAGATSGSPPAGRN

SEQ ID NO: 7940 - protein, 889 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCVPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKR

SEQ ID NO: 7941 - protein, 419 aa, Artificial Sequence
  Description of Artificial Sequence: Synthetic Chimeric Antigen Receptor sequence
DPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7942 - protein, 200 aa, Artificial Sequence
  Description of Artificial Sequence: Synthetic Chimeric Antigen Receptor sequence
DLEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7943 - protein, 688 aa, Artificial Sequence
  Description of Artificial Sequence: Synthetic Chimeric Antigen Receptor sequence
MDWIWRILFLVGAATGAHSQVQLQQPGAELVRPGASVKLSCKASGYTFSNYLMNWVKQRPEQDLDWIGRIDPYDGDIDYNQNFKDKAILTVDKSSSTAYMQLSSLTSEDSAVYYCARGYGTAYGVDYWGQGTSVTVSSAKTTPPKLEEGEFSEARVDIVLTQSPASLAVSLGQRATISCRASESVDNYGISFMNWFQQKPGQPPKLLIYAASRQGSGVPARFSGSGSGTDFSLNIHPMEEDDTAMYFCQQSKEVPWTFGGGTKLEIKAEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7944 - protein, 467 aa, Artificial Sequence
  Description of Artificial Sequence: Synthetic Chimeric Antigen Receptor sequence
MDWIWRILFLVGAATGAHSQVQLQQPGAELVRPGASVKLSCKASGYTFSNYLMNWVKQRPEQDLDWIGRIDPYDGDIDYNQNFKDKAILTVDKSSSTAYMQLSSLTSEDSAVYYCARGYGTAYGVDYWGQGTSVTVSSAKTTPPKLEEGEFSEARVDIVLTQSPASLAVSLGQRATISCRASESVDNYGISFMNWFQQKPGQPPKLLIYAASRQGSGVPARFSGSGSGTDFSLNIHPMEEDDTAMYFCQQSKEVPWTFGGGTKLEIKDLEPKSCDKTHTCPPCPDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7945 - protein, 487 aa, Artificial Sequence
  Description of Artificial Sequence: Synthetic Chimeric Antigen Receptor sequence
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7946 - protein, 362 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITLYKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7947 - protein, 410 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7948 - protein, 442 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7949 - protein, 541 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKIYIWAPLAGTCGVLLLSLVITKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7950 - protein, 373 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7951 - protein, 385 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7952 - protein, 492 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7953 - protein, 592 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7954 - protein, 340 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITLYKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7955 - protein, 388 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7956 - protein, 420 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFFKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7957 - protein, 519 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKIYIWAPLAGTCGVLLLSLVITKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7958 - protein, 351 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7959 - protein, 363 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7960 - protein, 470 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPGGGSSGGGSGGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7961 - protein, 570 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNESKYGPPCPPCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMFWVLVVVGGVLACYSLLVTVAFIIFWVRSKRSRGGHSDYMNMTPRRPGPTRKHYQPYAPPRDFAAYRSGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7962 - protein, 363 aa, Artificial Sequence
  Description of Artificial Sequence: Synthetic Chimeric Antigen Receptor sequence
MLLLVTSLLLCELPHPAFLLIPGPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7963 - protein, 341 aa, Artificial Sequence
  Description of Artificial Sequence: Synthetic Chimeric Antigen Receptor sequence
GPVPPSTALRYLIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGRFNAKPTTTPAPRPPTPAPTIASQPLSLRPEACRPAAGGAVHTRGLDFACDIYIWAPLAGTCGVLLLSLVITGGGKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7964 - protein, 688 aa, Artificial Sequence
  Description of Artificial Sequence: Synthetic Chimeric Antigen Receptor sequence
MEFGLSWLFLVAILKGVQCSRDIVMTQSQKFMSTSVGDRVSVTCKASQNVGTNVAWYQQKPGQSPKALIYSTSYRYSGVPDRFTGSGSGTDFTLTISNVQSEDLAEYFCQQYNSYPYTFGGGTKLEIKGGGGSGGGGSGGGGSEVQLQQSGAELVKPGASVKLSCTASGFNIKDTYMHWVKQRPEQGLEWIGRIDPANGNTKYDPKFQGKATIIADTSSNTAYLQLSSLTSEDTAVYYCARGVYHDYDGDYWGQGTTLTVSSYVTVSSQDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7965 - protein, 488 aa, Artificial Sequence
  Description of Artificial Sequence: Synthetic Chimeric Antigen Receptor sequence
MALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7966 - protein, 551 aa, Artificial Sequence
  Description of Artificial Sequence: Synthetic Chimeric Antigen Receptor sequence
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7967 - protein, 487 aa, Artificial Sequence
  Description of Artificial Sequence: Synthetic Chimeric Antigen Receptor sequence
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7968 - protein, 551 aa, Artificial Sequence
  Description of Artificial Sequence: Synthetic Chimeric Antigen Receptor sequence
MVLLVTSLLLCELPHPAFLLIPDIQQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGAGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7969 - protein, 490 aa, Artificial Sequence
  Description of Artificial Sequence: Synthetic Chimeric Antigen Receptor sequence
MVLLVTSLLLCELPHPAFLLIPDIQAQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7970 - protein, 554 aa, Artificial Sequence
  Description of Artificial Sequence: Synthetic Chimeric Antigen Receptor sequence
MVLLVTSLLLCELPHPAFLLIPDIQAQVQLVQSGAEVKRPGASVQVSCRASGYSINTYYMQWVRQAPGAGLEWMGVINPSGVTSYAQKFQGRVTLTNDTSTNTVYMQLNSLTSADTAVYYCARWALWGDFGMDVWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7971 - protein, 464 aa, Artificial Sequence
  Description of Artificial Sequence: Synthetic Chimeric Antigen Receptor sequence
MALPVTALLLPLALLLHAARPGSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSASTTTPAPRPPTPAPTIASRPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRGKGHDGLYQGLSTARKDTYDALHMQALPPT

SEQ ID NO: 7972 - protein, 511 aa, Artificial Sequence
  Description of Artificial Sequence: Synthetic Chimeric Antigen Receptor sequence
MALPVTALLLPLALLLHAARPGSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSASTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSIDRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7973 - protein, 507 aa, Artificial Sequence
  Description of Artificial Sequence: Synthetic Chimeric Antigen Receptor sequence
MALPVTALLLPLALLLHAARPGSQVQLQQSGPGLVTPSQTLSLTCAISGDSVSSNSATWNWIRQSPSRGLEWLGRTYYRSKWYNDYAVSVKSRMSINPDTSKNQFSLQLNSVTPEDTAVYYCARGMMTYYYGMDVWGQGTTVTVSSGILGSGGGGSGGGGSGGGGSQPVLTQSSSLSASPGASASLTCTLRSGINVGPYRIYWYQQKPGSPPQYLLNYKSDSDKQQGSGVPSRFSGSKDASANAGVLLISGLRSEDEADYYCMIWHSSAAVFGGGTQLTVLSASTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7974 - protein, 445 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7975 - protein, 738 aa, Artificial Sequence
  Description of Artificial Sequence: Synthetic Chimeric Antigen Receptor sequence
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRARGAAAGAGGAGRMVSELIKENMHMKLYMEGTVNNHHFKCTSEGEGKPYEGTQTMRIKAVEGGPLPFAFDILATSFMYGSKTFINHTQGIPDFFKQSFPEGFTWERVTTYEDGGVLTATQDTSLQDGCLIYNVKIRGVNFPSNGPVMQKKTLGWEASTETLYPADGGLEGRADMALKLVGGGHLICNLKTTYRSKKPAKNLKMPGVYYVDRRLERIKEADKETYVEQHEVAVARYCDLPSKLGHR

SEQ ID NO: 7976 - protein, 555 aa, Artificial Sequence
  Description of Artificial Sequence: Synthetic Chimeric Antigen Receptor sequence
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRDQRLPPDAHKPPGECLMALPHCSWRVRPTHQSLLFSSPGGGSFRTPIQEEQADAHSTLAKIRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7977 - protein, 535 aa, Artificial Sequence
  Description of Artificial Sequence: Synthetic Chimeric Antigen Receptor sequence
MALPVTALLLPLALLLHAARPEVQLQQSGGERATPGASVKMSCKTSGYTFTNYWMHWVKQRPGQGLEWIGYINPSSGYTQYNQKFKDKATLTADKSSSTAYIQLSSLTSEDSAVYYCSTYYGDYLFPYWGQGTLVTVSAGGGGSGGGGSGGGGSDVLMTQTPLSLPVSLGDQASISCRSSQDIVYGNGNTYLEWYLQKPGQSPKLLIYKVSNRFSGVPDRFSGSGSGTDFTLKISRVEAEDLGVYYCFQGSHVPYTFGGGTKLEIKRAAAIEVEQKLISEEDLLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7978 - protein, 463 aa, Artificial Sequence
  Description of Artificial Sequence: Synthetic Chimeric Antigen Receptor sequence
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7979 - protein, 486 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7980 - protein, 487 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7981 - protein, 528 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7982 - protein, 513 aa, Artificial Sequence
  Description of Artificial Sequence: Synthetic Chimeric Antigen Receptor sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7983 - protein, 451 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7984 - protein, 492 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7985 - protein, 493 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7986 - protein, 488 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7987 - protein, 529 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7988 - protein, 482 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7989 - protein, 523 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7990 - protein, 1397 aa, Artificial Sequence
  Description of Artificial Sequence: Synthetic Chimeric Antigen Receptor sequence
MEEISAAAVKVVPGPERPSPFSQLVYTSNDSYIVHSGDLRKIHKAASRGQVRKLEKMTKRKKTINLNIQDAQKRTALHWACVNGHEEVVTFLVDRKCQLDVLDGEHRTPLMKALQCHQEACANILIDSGADINLVDVYGNTALHYAVYSEILSVVAKLLSHGAVIEVHNKASLTPLLLSITKRSEQIVEFLLIKNANANAVNKYKCTALMLAVCHGSSEIVGMLLQQNVDVFAADICGVTAEHYAVTCGFHHIHEQIMEYIRKLSKNHQNTNPEGTSAGTPDEAAPLAERTPDTAESLVEKTPDEAAPLVERTPDTAESLVEKTPDEAASLVEGTSDKIQCLEKATSGKFEQSAEETPREITSPAKETSEKFTWPAKGRPRKIAWEKKEDTPREIMSPAKETSEKFTWAAKGRPRKIAWEKKETPVKTGCVARVTSNKTKVLEKGRSKMIACPTKESSTKASANDQRFPSESKQEEDEEYSCDSRSLFESSAKIQVCIPESIYQKVMEINREVEEPPKKPSAFKPAIEMQNSVPNKAFELKNEQTLRADPMFPPESKQKDYEENSWDSESLCETVSQKDVCLPKATHQKEIDKINGKLEESPNKDGLLKATCGMKVSIPTKALELKDMQTFKAEPPGKPSAFEPATEMQKSVPNKALELKNEQTLRADEILPSESKQKDYEENSWDTESLCETVSQKDVCLPKAAHQKEIDKINGKLEGSPVKDGLLKANCGMKVSIPTKALELMDMQTFKAEPPEKPSAFEPAIEMQKSVPNKALELKNEQTLRADEILPSESKQKDYEESSWDSESLCETVSQKDVCLPKATHQKEIDKINGKLEESPDNDGFLKAPCRMKVSIPTKALELMDMQTFKAEPPEKPSAFEPAIEMQKSVPNKALELKNEQTLRADQMFPSESKQKKVEENSWDSESLRETVSQKDVCVPKATHQKEMDKISGKLEDSTSLSKILDTVHSCERARELQKDHCEQRTGKMEQMKKKFCVLKKKLSEAKEIKSQLENQKVKWEQELCSVRLTLNQEEEKRRNADILNEKIREELGRIEEQHRKELEVKQQLEQALRIQDIELKSVESNLNQVSHTHENENYLLHENCMLKKEIAMLKLEIATLKHQYQEKENKYFEDIKILKEKNAELQMTLKLKEESLTKRASQYSGQLKVLIAENTMLTSKLKEKQDKEILEAEIESHHPRLASAVQDHDQIVTSRKSQEPAFHIAGDACLQRKMNVDVSSTIYNNEVLHQPLSEAQRKSKSLKINLNYAGDALRENTLVSEHAQRDQRETQCQMKEAEHMYQNEQDNVNKHTEQQESLDQKLFQLQSKNMWLQQQLVHAHKKADNKSKITIDIHFLERKMQHHLLKEKNEEIFNYNNHLKNRIYQYEKEKAETENS

SEQ ID NO: 7991 - protein, 394 aa, Artificial Sequence
  Description of Artificial Sequence: Synthetic Chimeric Antigen Receptor sequence
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7992 - protein, 527 aa, Artificial Sequence
  Description of Artificial Sequence: Synthetic Chimeric Antigen Receptor sequence
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7993 - protein, 486 aa, Artificial Sequence
  Description of Artificial Sequence: Synthetic Chimeric Antigen Receptor sequence
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSAGGGGSGGGGSGGGGSDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKAAAFVPVFLPAKPTTTPAPRPPTPAPTIASQPLSLRPEACRPAAGGAVHTRGLDFACDIYIWAPLAGTCGVLLLSLVITLYCNHRNRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7994 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSSSYLAWYQQKPGQAPRLLMYDASIRATGIPDRFSGSGSGTDFTLTISRLEPEDFAVYYCQQYGSWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7995 - protein, 463 aa, Artificial Sequence; identical to SEQ ID NO: 7978
  Description of Artificial Sequence: Synthetic Chimeric Antigen Receptor sequence

SEQ ID NO: 7996 - protein, 527 aa, Artificial Sequence; identical to SEQ ID NO: 7992
  Description of Artificial Sequence: Synthetic Chimeric Antigen Receptor sequence

SEQ ID NO: 7997 - protein, 486 aa, Artificial Sequence; identical to SEQ ID NO: 7993
  Description of Artificial Sequence: Synthetic Chimeric Antigen Receptor sequence

SEQ ID NO: 7998 - protein, 489 aa, Artificial Sequence
  Description of Artificial Sequence: Synthetic Chimeric Antigen Receptor sequence
MALPVTALLLPLALLLHAARPAIRMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIKRGGGGSGGGGSGGGGSEVQLVESGGGLVKPGGSLRLSCAASGFTFSDYYMSWIRQAPGKGLEWVSYISDSTNTIYYADSVKGRFTVSRDNPKNSLYLQMISLRAEDTAVYYCARAVGAGEGFDHWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7999 - protein, 482 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSSSYLAWYQQKPGQAPRLLMYDASIRATGIPDRFSGSGSGTDFTLTISRLEPEDFAVYYCQQYGSWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8000 - protein, 668 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSSSYLAWYQQKPGQAPRLLMYDASIRATGIPDRFSGSGSGTDFTLTISRLEPEDFAVYYCQQYGSWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8001 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8002 - protein, 482 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8003 - protein, 519 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8004 - protein, 519 aa, Artificial Sequence; identical to SEQ ID NO: 8003
  Description of Artificial Sequence: Synthetic Chimeric Antigen Receptor sequence

SEQ ID NO: 8005 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDFGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSDIYLAWYQQKPGQAPRLLMYDASIRATGIPDRFSGSGSGTDFTLTISRLEPEDFAVYYCQQYQTWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8006 - protein, 482 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDFGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSDIYLAWYQQKPGQAPRLLMYDASIRATGIPDRFSGSGSGTDFTLTISRLEPEDFAVYYCQQYQTWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8007 - protein, 668 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYAMNWVRQAPGKGLEWVSAISDFGGSTYYADSVKGRFTISRDNSKNTLYLQMNSLRAEDTAVYYCARYWPMDIWGQGTLVTVSSGGGGSGGGGSGGGGSEIVLTQSPGTLSLSPGERATLSCRASQSVSDIYLAWYQQKPGQAPRLLMYDASIRATGIPDRFSGSGSGTDFTLTISRLEPEDFAVYYCQQYQTWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8008 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFGSYAMTWVRQAPGKGLEWVSAISGSGGNTFYADSVKGRFTISRDNSKNTLYLQMNSLRAEDTAVYYCARVSPIAAPMDYWGQGTLVTVSSGGGGSGGGGSGGGGSEIVLTQSPGTLSLSPGERATLSCRASQLGSFYLAWYQQKPGQAPRLLIYGASSRATGIPDRFSGSGSGTDFTLTISRLEPEDFAVYYCQHYNYPPSFTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQA

SEQ ID NO: 8009 - protein, 486 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFGSYAMTWVRQAPGKGLEWVSAISGSGGNTFYADSVKGRFTISRDNSKNTLYLQMNSLRAEDTAVYYCARVSPIAAPMDYWGQGTLVTVSSGGGGSGGGGSGGGGSEIVLTQSPGTLSLSPGERATLSCRASQLGSFYLAWYQQKPGQAPRLLIYGASSRATGIPDRFSGSGSGTDFTLTISRLEPEDFAVYYCQHYNYPPSFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8010 - protein, 672 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFGSYAMTWVRQAPGKGLEWVSAISGSGGNTFYADSVKGRFTISRDNSKNTLYLQMNSLRAEDTAVYYCARVSPIAAPMDYWGQGTLVTVSSGGGGSGGGGSGGGGSEIVLTQSPGTLSLSPGERATLSCRASQLGSFYLAWYQQKPGQAPRLLIYGASSRATGIPDRFSGSGSGTDFTLTISRLEPEDFAVYYCQHYNYPPSFTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8011 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFGSYAMTWVRQAPGKGLEWVSAIDYSGGNTFYADSVKGRFTISRDNSKNTLYLQMNSLRAEDTAVYYCARVSPIASGMDYWGQGTLVTVSSGGGGSGGGGSGGGGSEIVLTQSPGTLSLSPGERATLSCRASQSVSSSYPSWYQQKPGQAPRLLIYGASSRATGIPDRFSGSGSGTDFTLTISRLEPEDFAVYYCQHYPYPPSFTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQ

SEQ ID NO: 8012 - protein, 487 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFGSYAMTWVRQAPGKGLEWVSAIDYSGGNTFYADSVKGRFTISRDNSKNTLYLQMNSLRAEDTAVYYCARVSPIASGMDYWGQGTLVTVSSGGGGSGGGGSGGGGSEIVLTQSPGTLSLSPGERATLSCRASQSVSSSYPSWYQQKPGQAPRLLIYGASSRATGIPDRFSGSGSGTDFTLTISRLEPEDFAVYYCQHYPYPPSFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8013 - protein, 673 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFGSYAMTWVRQAPGKGLEWVSAIDYSGGNTFYADSVKGRFTISRDNSKNTLYLQMNSLRAEDTAVYYCARVSPIASGMDYWGQGTLVTVSSGGGGSGGGGSGGGGSEIVLTQSPGTLSLSPGERATLSCRASQSVSSSYPSWYQQKPGQAPRLLIYGASSRATGIPDRFSGSGSGTDFTLTISRLEPEDFAVYYCQHYPYPPSFTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8014 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYPMSWVRQAPGKGLEWVSAIGGSGGSTYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCRASQSVSSTYLAWYQQKPGQAPRLLIYDASSRAPGIPDRFSGSGSGTDFTLTISRLEPEDFAVYYCQQYSTSPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8015 - protein, 482 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYPMSWVRQAPGKGLEWVSAIGGSGGSTYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCRASQSVSSTYLAWYQQKPGQAPRLLIYDASSRAPGIPDRFSGSGSGTDFTLTISRLEPEDFAVYYCQQYSTSPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8016 - protein, 482 aa, Artificial Sequence; identical to SEQ ID NO: 8015
  Description of Artificial Sequence: Synthetic Chimeric Antigen Receptor sequence

SEQ ID NO: 8017 - protein, 453 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYPMSWVRQAPGKGLEWVSAIGGSGGWSYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCWLSQSVSSTYLAWYQQKPGQAPRLLIYDASSRAPGIPDRFSGSGSGTDFTLTISRLEPEDFAVYYCQQYSEWPLTFGQGTKVEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8018 - protein, 482 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYPMSWVRQAPGKGLEWVSAIGGSGGWSYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCWLSQSVSSTYLAWYQQKPGQAPRLLIYDASSRAPGIPDRFSGSGSGTDFTLTISRLEPEDFAVYYCQQYSEWPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8019 - protein, 668 aa, Artificial Sequence
  Description of Artificial Sequence: Synthetic Chimeric Antigen Receptor sequence
MALPVTALLLPLALLLHAARPEVQLLESGGGLVQPGGSLRLSCAASGFTFSSYPMSWVRQAPGKGLEWVSAIGGSGGWSYYADSVKGRFTISRDNSKNTLYLQMNSLRAEDTAVYYCARYWPMDSWGQGTLVTVSSGGGGSGGGGSGGGGSEIVLTQSPGTLSLSPGERATLSCWLSQSVSSTYLAWYQQKPGQAPRLLIYDASSRAPGIPDRFSGSGSGTDFTLTISRLEPEDFAVYYCQQYSEWPLTFGQGTKVEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8020 - protein, 373 aa, Artificial Sequence
  Description of Artificial Sequence: Synthetic Chimeric Antigen Receptor sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8021 - protein, 394 aa, Artificial Sequence; identical to SEQ ID NO: 7991
  Description of Artificial Sequence: Synthetic Chimeric Antigen Receptor sequence

SEQ ID NO: 8022 - protein, 372 aa, Artificial Sequence
  Description of Artificial Sequence: Synthetic Chimeric Antigen Receptor sequence
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTVLCGAISLAPKAQIKESHAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8023 - protein, 394 aa, Artificial Sequence; identical to SEQ ID NO: 7991
  Description of Artificial Sequence: Synthetic Chimeric Antigen Receptor sequence

SEQ ID NO: 8024 - protein, 488 aa, Artificial Sequence
  Description of Artificial Sequence: Synthetic Chimeric Antigen Receptor sequence
MALPVTALLLPLALLLHAARPQVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8025 - protein, 497 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8026 - protein, 490 aa, Artificial Sequence
  Description of Artificial Sequence: Synthetic Chimeric Antigen Receptor sequence
MALPVTALLLPLALLLHAARPQVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8027 - protein, 486 aa, Artificial Sequence
  Description of Artificial Sequence: Synthetic Chimeric Antigen Receptor sequence
MALPVTALLLPLALLLHAARPQVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8028 - protein, 485 aa, Artificial Sequence
  Description of Artificial Sequence: Synthetic Chimeric Antigen Receptor sequence
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8029 - protein, 497 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8030 - protein, 494 aa, Artificial Sequence
  Description of Artificial Sequence: Synthetic Chimeric Antigen Receptor sequence
MALPVTALLLPLALLLHAARPQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8031 - protein, 490 aa, Artificial Sequence
  Description of Artificial Sequence: Synthetic Chimeric Antigen Receptor sequence
MALPVTALLLPLALLLHAARPQVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8032 - protein, 492 aa, Artificial Sequence
  Description of Artificial Sequence: Synthetic Chimeric Antigen Receptor sequence
MALPVTALLLPLALLLHAARPQVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8033 - protein, 499 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8034 - protein, 485 aa, Artificial Sequence
  Description of Artificial Sequence: Synthetic Chimeric Antigen Receptor sequence
MALPVTALLLPLALLLHAARPQVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8035 - protein, 490 aa, Artificial Sequence
  Description of Artificial Sequence: Synthetic Chimeric Antigen Receptor sequence
MALPVTALLLPLALLLHAARPQVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8036 - protein, 493 aa, Artificial Sequence
  Description of Artificial Sequence: Synthetic Chimeric Antigen Receptor sequence
MALPVTALLLPLALLLHAARPQVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8037 - protein, 493 aa, Artificial Sequence
  Description of Artificial Sequence: Synthetic Chimeric Antigen Receptor sequence
MALPVTALLLPLALLLHAARPQVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8038 - protein, 488 aa, Artificial Sequence
  Description of Artificial Sequence: Synthetic Chimeric Antigen Receptor sequence
MALPVTALLLPLALLLHAARPQVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8039 - protein, 490 aa, Artificial Sequence
  Description of Artificial Sequence: Synthetic Chimeric Antigen Receptor sequence
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8040 - protein, 490 aa, Artificial Sequence
  Description of Artificial Sequence: Synthetic Chimeric Antigen Receptor sequence
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8041 - protein, 495 aa, Artificial Sequence
  Description of Artificial Sequence: Synthetic Chimeric Antigen Receptor sequence
MALPVTALLLPLALLLHAARPQVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8042 - protein, 494 aa, Artificial Sequence
  Description of Artificial Sequence: Synthetic Chimeric Antigen Receptor sequence
MALPVTALLLPLALLLHAARPQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8043 - protein, 493 aa, Artificial Sequence
  Description of Artificial Sequence: Synthetic Chimeric Antigen Receptor sequence
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8044 - protein, 491 aa, Artificial Sequence
  Description of Artificial Sequence: Synthetic Chimeric Antigen Receptor sequence
MALPVTALLLPLALLLHAARPQVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8045 - protein, 497 aa, Artificial Sequence
  Description of Artificial Sequence: Synthetic Chimeric Antigen Receptor sequence
MALPVTALLLPLALLLHAARPQVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8046 - protein, 493 aa, Artificial Sequence
  Description of Artificial Sequence: Synthetic Chimeric Antigen Receptor sequence
MALPVTALLLPLALLLHAARPQVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8047 - protein, 490 aa, Artificial Sequence
  Description of Artificial Sequence: Synthetic Chimeric Antigen Receptor sequence
MALPVTALLLPLALLLHAARPQITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8048 - protein, 390 aa, Artificial Sequence
  Description of Artificial Sequence: Synthetic Chimeric Antigen Receptor sequence
MALPVTALLLPLALLLHAARPPGWFLDSPDRPWPPTFSPALLVVTEGDNATFTCSFSNTSESFVLNWYRMSPSNQTDKLAAFPEDRSQPGQDCRFRVTQLPNGRDFHMSVWARRDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDRYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKPQEGLYNELQKDKMAEAYSEIGMKGERRRGKGHDGLYQGLSTATKDTYDALHMQALPPR

SEQ ID NO: 8049 - protein, 394 aa, Artificial Sequence; identical to SEQ ID NO: 7991
  Description of Artificial Sequence: Synthetic Chimeric Antigen Receptor sequence

SEQ ID NO: 8050 - protein, 394 aa, Artificial Sequence
  Description of Artificial Sequence: Synthetic Chimeric Antigen Receptor sequence
MALPVTALLLPLALLLHAARPPGWFLDSPDRPWNPPTFSPALLVVTEGDNATFTCSFSNTSESFVLNWVRMSPSNQTDKLAAFPEDRSQPGQDCRFRVTQLPNGRDFHMSVVRARRNDSGTVLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8051 - protein, 386 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAIELLPVPGAKKSAKLYIPYIILTIIILTIVGFIWLLKVNGCRKYKLNKTESTPVVEEDEMQPYASYTEKNNPLYDTTNKVKASEALQSEVDTDLHTLSHG

SEQ ID NO: 8052 - protein, 373 aa, Artificial Sequence; identical to SEQ ID NO: 8020
  Description of Artificial Sequence: Synthetic Chimeric Antigen Receptor sequence

SEQ ID NO: 8053 - protein, 354 aa, Artificial Sequence
  Description of Artificial Sequence: Synthetic Chimeric Antigen Receptor sequence
MALPVTALLLPLALLLHAARPPGWFLDSPDRPWNPPTFSPALLVVTEGDNATFTCSFSNTSESFYLNWYRMSPSNQTDKLAAFPEDRSQPGQDCRFRVTQLPNGRDFHMSVYRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8054 - protein, 373 aa, Artificial Sequence
  Description of Artificial Sequence: Synthetic Chimeric Antigen Receptor sequence
PGWFLDSPDRPWNPPTFSPALLVVTEGDNATFTCSFSNTSESFYLNWYRMSPSNQTDKLAAFPEDRSQPGQDCRFRVTQLPNGRDFHMSVYRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8055 - DNA, 1182 bp, Artificial Sequence
  Description of Artificial Sequence: Synthetic Chimeric Antigen Receptor sequence
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 8056 - protein, 394 aa, Artificial Sequence
  Description of Artificial Sequence: Synthetic Chimeric Antigen Receptor sequence
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAEIRVTERRAEVPTAHPSPSPRPAGQFQTLVTTTPAPRPPTPAPTIASQPLSLRPEACRPAAGGAVHTRGLDFACDIYIWAPLAGTCGVLIISLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8057 - protein, 373 aa, Artificial Sequence; identical to SEQ ID NO: 8020
  Description of Artificial Sequence: Synthetic Chimeric Antigen Receptor sequence

SEQ ID NO: 8058 - protein, 367 aa, Artificial Sequence
  Description of Artificial Sequence: Synthetic Chimeric Antigen Receptor sequence
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLGGGGSGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 8059 - protein, 356 aa, Artificial Sequence
  Description of Artificial Sequence: Synthetic Chimeric Antigen Receptor sequence
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTARPSPSPRPAGQFQTLVTTTPAPRPPTPAPTIASQPLSLRPEACRPAAGGAVHTRGLDFACDIYIWAPLAGTCGVLLLSLVITLYCKRGRKKLLGGGGSGGGGSASRILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 8060 - protein, 356 aa, Artificial Sequence
  Description of Artificial Sequence: Synthetic Chimeric Antigen Receptor sequence
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLGGGGSGGGGSASRILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 8061 - protein, 425 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQSHG

SEQ ID NO: 8062 - protein, 386 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVQAPSSSPMGIIVAVVTGIAVAAIVAAVVALIYCRKKRISALPGYPECREMGETLPEKPANPTNPDEADKVGAENTITYSLLMHPDALEEPDDQNRISHG

SEQ ID NO: 8063 - protein, 427 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAMSHG

SEQ ID NO: 8064 - protein, 410 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKSSHG

SEQ ID NO: 8065 - protein, 460 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGTSRNRTGLTAAGITGLVLSILVLAAAAALLHYARARRKPGGLSATGTSSHSPSECQEPSSSRPSRIDPQEPTHSKPLAPMELEPMYSNANPGDSNPIYSQIWSIQHTKENSANCPMMHQEHEELTVLYSELKKTHPDDSAGEASSRGRAHEEDDEENYENVPRVLLASDHSHG

SEQ ID NO: 8066 - protein, 430 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEESSHG

SEQ ID NO: 8067 - protein, 432 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHRSHG

SEQ ID NO: 8068 - protein, 432 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSKSSDPLLVSVTGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYTELPNAESRSKVVSCPSHG

SEQ ID NO: 8069 - protein, 432 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSNSSDPLLVSVIGNPSNSWPSPTEPSSKTGNPRHLHILIGTSVVIILFILLFFLLHRWCSNKKNAAVMDQESAGNRTANSEDSDEQDPQEVTYTQLNHCVFTQRKITRPSQRPKTPPTDIIVYAELPNAESRSKVVSCPSHG

SEQ ID NO: 8070 - protein, 425 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEPSHG

SEQ ID NO: 8071 - protein, 464 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSDASDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSHVPAAGISHG

SEQ ID NO: 8072 - protein, 464 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGISHG

SEQ ID NO: 8073 - protein, 433 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCPSHG

SEQ ID NO: 8074 - protein, 444 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVFSHG

SEQ ID NO: 8075 - protein, 404 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSASFRALPHAWSDPSDPLPVSVTGNSRYLHALIGTSVVIIPFAILLFFLLHRWCANKKNAVVMDQEPAGNRTVNREDSDEQDPQEVTYAQLNHCVFTQRKITRPSQRPKTPPTDTSVSHG

SEQ ID NO: 8076 - protein, 468 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIHSHG

SEQ ID NO: 8077 - protein, 501 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIHSHG

SEQ ID NO: 8078 - protein, 519 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGSLEGPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIHSHG

SEQ ID NO: 8079 - protein, 461 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIHSHG

SEQ ID NO: 8080 - protein, 419 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAMPSTGGDSCPFCLKLLLPGLLLLLVVIILILAFWVLPKYKTRKAMRNNVPRDRGDTAMEVGIYANILEKQAKEESVPEVGSRPCVSTAQDEAKHSQELQYATPVFQEVAPREQEACDSYKSGYVYSELNFSHG

SEQ ID NO: 8081 - protein, 412 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKNSHG

SEQ ID NO: 8082 - protein, 405 aa, Artificial Sequence
  Description of Artificial Sequence: Synthetic Chimeric Antigen Receptor sequence
MALPVTALLLPLALLLHAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAATERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSH

SEQ ID NO: 8083 - protein, 432 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSHG

SEQ ID NO: 8084 - protein, 436 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGTSHG

SEQ ID NO: 8085 - protein, 442 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPKAPPSHRPLKSPQNETLYSVLKASHG

SEQ ID NO: 8086 - protein, 378 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVKEGPPSEHSGISRNAIIFLVLGILVFLILLGIGIYFYWSKCSREVLWHCHLCPSSTEHASASANGHVSYSAVSRENSSSQDPQTEGTRSHG

SEQ ID NO: 8087 - protein, 545 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQSHG

SEQ ID NO: 8088 - protein, 535 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPKSHG

SEQ ID NO: 8089 - protein, 422 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPKSHG

SEQ ID NO: 8090 - protein, 510 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVYSLPQLLGPSCSWEAEGLHCRCSFRAWPAPSLCWRLEEKPLEGNSSQGSFKVNSSSPGPWANSSLILHGGLNSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSKSHG

SEQ ID NO: 8091 - protein, 409 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHKSHG

SEQ ID NO: 8092 - protein, 420 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPKSHG

SEQ ID NO: 8093 - protein, 444 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRGSHG

SEQ ID NO: 8094 - protein, 416 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSALQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHRSHG

SEQ ID NO: 8095 - protein, 528 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHG

SEQ ID NO: 8096 - protein, 551 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHG

SEQ ID NO: 8097 - protein, 495 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHG

SEQ ID NO: 8098 - protein, 792 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLESHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 8099 - protein, 815 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMSSHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 8100 - protein, 759 aa, Artificial Sequence
  Description of Artificial Sequence: Synthetic Chimeric Antigen Receptor sequence
MALPVTALLLPLALLLHAARPGSGSGAQAAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAARSDPASGAGSGSGSAKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCLSHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 8101 - protein, 670 aa, Artificial Sequence
  Description of Artificial Sequence: Synthetic Chimeric Antigen Receptor sequence
MALPVTALLLPLALLLHAEVQLQQSGPELVKPGTSVRISCKTSGYTFTEYTIHWVKQSHGKSLEWIGNINPNNGGTTYNQKFEDKATLTVDKSSSTAYMELRSLTSEDSAVYYCAAGWNFDYWGQGTTVTVSSGGGGSGGGGSGGGGSDIVMTQSHKFMSTSVGDRVSIICKASQDVGTAVDWYQQKPGQSPKLLIYWASTRHTGVPDRFTGSGSGTDFTLTITNVQSEDLADYFCQQYNSYPLTFGAGTMLDLKRAAATERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLSHGGSGEGRGSLLTCGDVEENPGPHMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKAAD

SEQ ID NO: 8102 - protein, 434 aa, Artificial Sequence
  Description of Artificial Sequence: Synthetic Chimeric Antigen Receptor sequence
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8103 - protein, 437 aa, Artificial Sequence
  Description of Artificial Sequence: Synthetic Chimeric Antigen Receptor sequence
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8104 - protein, 463 aa, Artificial Sequence
  Description of Artificial Sequence: Synthetic Chimeric Antigen Receptor sequence
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8105 - protein, 466 aa, Artificial Sequence
  Description of Artificial Sequence: Synthetic Chimeric Antigen Receptor sequence
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8106 - protein, 649 aa, Artificial Sequence
  Description of Artificial Sequence: Synthetic Chimeric Antigen Receptor sequence
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8107 - protein, 652 aa, Artificial Sequence
  Description of Artificial Sequence: Synthetic Chimeric Antigen Receptor sequence
QVQLQQSGAELVRPGASVTLSCKASGYTFSDYEMHWVIQTPVHGLEWIGAIDPETGGTAYNQKFKGKAILTADKSSSTAYMELRSLTSEDSAVYYCTGYYDYDSFTYWGQGTLVTVSAGGGGSGGGGSGGGGSDIVMTQSQKIMSTTVGDRVSITCKASQNVDAAVAWYQQKPGQSPKLLIYSASNRYTGVPDRFTGSGSGTDFTLTISNMQSEDLADYFCQQYDIYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8108 - protein, 435 aa, Artificial Sequence
  Description of Artificial Sequence: Synthetic Chimeric Antigen Receptor sequence
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8109 - protein, 438 aa, Artificial Sequence
  Description of Artificial Sequence: Synthetic Chimeric Antigen Receptor sequence
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8110 - protein, 464 aa, Artificial Sequence
  Description of Artificial Sequence: Synthetic Chimeric Antigen Receptor sequence
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8111 - protein, 467 aa, Artificial Sequence
  Description of Artificial Sequence: Synthetic Chimeric Antigen Receptor sequence
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8112 - protein, 650 aa, Artificial Sequence
  Description of Artificial Sequence: Synthetic Chimeric Antigen Receptor sequence
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8113 - protein, 653 aa, Artificial Sequence
  Description of Artificial Sequence: Synthetic Chimeric Antigen Receptor sequence
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSGGGGSGGGGSGGGGSDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8114 - protein, 432 aa, Artificial Sequence
  Description of Artificial Sequence: Synthetic Chimeric Antigen Receptor sequence
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8115 - protein, 435 aa, Artificial Sequence
  Description of Artificial Sequence: Synthetic Chimeric Antigen Receptor sequence
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8116 - protein, 461 aa, Artificial Sequence
  Description of Artificial Sequence: Synthetic Chimeric Antigen Receptor sequence
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8117 - protein, 464 aa, Artificial Sequence
  Description of Artificial Sequence: Synthetic Chimeric Antigen Receptor sequence
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8118 - protein, 647 aa, Artificial Sequence
  Description of Artificial Sequence: Synthetic Chimeric Antigen Receptor sequence
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8119 - protein, 650 aa, Artificial Sequence
  Description of Artificial Sequence: Synthetic Chimeric Antigen Receptor sequence
QVQLKESGPGLVAPSQTLSITCTVSGFSLTSYGVHWVRQPPGKGLEWLGVIWAGGFTNYNSALKSRLSISKDNSKSQVLLKMTSLQTDDTAMYYCARRGSSYSMDYWGQGTSVTVSSGGGGSGGGGSGGGGSEIVLSQSPAITAASLGQKVTITCSASSNVSYIHWYQQRSGTSPRPWIYEISKLASGVPVRFSGSGSGTSYSLTISSMEAEDAAIYYCQQWNYPLITFGSGTKLEIQEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8120 - protein, 435 aa, Artificial Sequence
  Description of Artificial Sequence: Synthetic Chimeric Antigen Receptor sequence
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8121 - protein, 438 aa, Artificial Sequence
  Description of Artificial Sequence: Synthetic Chimeric Antigen Receptor sequence
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8122 - protein, 464 aa, Artificial Sequence
  Description of Artificial Sequence: Synthetic Chimeric Antigen Receptor sequence
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8123 - protein, 467 aa, Artificial Sequence
  Description of Artificial Sequence: Synthetic Chimeric Antigen Receptor sequence
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8124 - protein, 650 aa, Artificial Sequence
  Description of Artificial Sequence: Synthetic Chimeric Antigen Receptor sequence
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8125 - protein, 653 aa, Artificial Sequence
  Description of Artificial Sequence: Synthetic Chimeric Antigen Receptor sequence
EVQLQQSGPELEKPGASVKISCKASGFAFTGYNMNWVKQTNGKSLEWIGSIDPYYGGSTYNQKFKDKATLTVDKSSSTAYMQLKSLTSDDSAVYYCARSPGGDYAMDYWGQGTSVTVSSGGGGSGGGGSGGGGSDIKMTQSPSSMYASVGERVTITCKASQGINSYSGWFQQKPGKSPKTLIYRGNRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8126 - protein, 435 aa, Artificial Sequence
  Description of Artificial Sequence: Synthetic Chimeric Antigen Receptor sequence
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8127 - protein, 438 aa, Artificial Sequence
  Description of Artificial Sequence: Synthetic Chimeric Antigen Receptor sequence
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8128 - protein, 464 aa, Artificial Sequence
  Description of Artificial Sequence: Synthetic Chimeric Antigen Receptor sequence
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8129 - protein, 467 aa, Artificial Sequence
  Description of Artificial Sequence: Synthetic Chimeric Antigen Receptor sequence
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8130 - protein, 650 aa, Artificial Sequence
  Description of Artificial Sequence: Synthetic Chimeric Antigen Receptor sequence
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8131 - protein, 653 aa, Artificial Sequence
  Description of Artificial Sequence: Synthetic Chimeric Antigen Receptor sequence
QVQLQQPGAELVKPGTSVKLSCKASGYNFTNYWINWVKLRPGQGLEWIGEIYPGSGSTNYNEKFKSKATLTADTSSSTAYMQLSSLASEDSALYYCARDGNYYAMDYWGQGTSVTVSSGGGGSGGGGSGGGGSDIQMTQTTSSLSASLGDRVTITCRASQDINNYLNWYQQKPDGTVKLLIYYTSALHSGVPSRFSGSGSGTDYSLTISNLEQEDIATYFCQQGNTLPPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8132 - protein, 434 aa, Artificial Sequence
  Description of Artificial Sequence: Synthetic Chimeric Antigen Receptor sequence
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8133 - protein, 437 aa, Artificial Sequence
  Description of Artificial Sequence: Synthetic Chimeric Antigen Receptor sequence
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8134 - protein, 463 aa, Artificial Sequence
  Description of Artificial Sequence: Synthetic Chimeric Antigen Receptor sequence
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8135 - protein, 466 aa, Artificial Sequence
  Description of Artificial Sequence: Synthetic Chimeric Antigen Receptor sequence
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8136 - protein, 649 aa, Artificial Sequence
  Description of Artificial Sequence: Synthetic Chimeric Antigen Receptor sequence
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8137 - protein, 652 aa, Artificial Sequence
  Description of Artificial Sequence: Synthetic Chimeric Antigen Receptor sequence
EVKLVESGGGLVKPGGSLKLSCAASGFTFSSYAMSWVRQTPEKRLEWVASISTGASAYFPDSVKGRFTISRDNARNILYLQMSSLRSEDTAMYYCARITTSTWYFDVWGAGTTVTVSSGGGGSGGGGSGGGGSDIKMTQSPSSMYASLGERVTITCKASQDINSYLSWFQQKPGKSPKTLIYRANRLVDGVPSRFSGSGSGQDYSLTISSLEYEDMGIYYCLQYDEFPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8138 - protein, 430 aa, Artificial Sequence
  Description of Artificial Sequence: Synthetic Chimeric Antigen Receptor sequence
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8139 - protein, 433 aa, Artificial Sequence
  Description of Artificial Sequence: Synthetic Chimeric Antigen Receptor sequence
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8140 - protein, 459 aa, Artificial Sequence
  Description of Artificial Sequence: Synthetic Chimeric Antigen Receptor sequence
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8141 - protein, 462 aa, Artificial Sequence
  Description of Artificial Sequence: Synthetic Chimeric Antigen Receptor sequence
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8142 - protein, 645 aa, Artificial Sequence
  Description of Artificial Sequence: Synthetic Chimeric Antigen Receptor sequence
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8143 - protein, 648 aa, Artificial Sequence
  Description of Artificial Sequence: Synthetic Chimeric Antigen Receptor sequence
EVKLQQSGPELVKPGASVKISCKTSGYTFTEYTMHWVKQSHGKSLEWIGGINPNNGGTSYNQKFKGKATLTVDKSSSTAYMELRSLTSEDSAVYYCALQGFAYWGQGTPLTVSSGGGGSGGGGSGGGGSMEIEITQTPALMSASPGEKVTMTCSASSSVSYMYWYQQKPRSSPKPWIYLTSNLASGVPARFSGSGSGTSYSLTISSMEAEDAATYYCQQWSSNPYTFGGGTRLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8144 - protein, 436 aa, Artificial Sequence
  Description of Artificial Sequence: Synthetic Chimeric Antigen Receptor sequence
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8145 - protein, 439 aa, Artificial Sequence
  Description of Artificial Sequence: Synthetic Chimeric Antigen Receptor sequence
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8146 - protein, 486 aa, Artificial Sequence
  Description of Artificial Sequence: Synthetic Chimeric Antigen Receptor sequence
MALPVTALLLPLALLLHAARPEVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8147 - protein, 468 aa, Artificial Sequence
  Description of Artificial Sequence: Synthetic Chimeric Antigen Receptor sequence
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8148 - protein, 651 aa, Artificial Sequence
  Description of Artificial Sequence: Synthetic Chimeric Antigen Receptor sequence
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8149 - protein, 654 aa, Artificial Sequence
  Description of Artificial Sequence: Synthetic Chimeric Antigen Receptor sequence
EVKLQESGAELARPGASVKMSCKASGYTFTSYTMHWVKQRPGQGLEWIGYINPSSGYTEYNQKFKDKTTLTADKSSSTAYMQLSSLTSGDSAVYYCARRVLWLRRGDYWGQGTILTVSAGGGGSGGGGSGGGGSMEVLITQTPSSLSASLGERVSLTCRASQDIGSSLNWLQQEPDGTIKRLIYATSSLDSGVPKRFSGSRSGSDYSLTISSLESEDFVDYYCLQYASSPYTFGGGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8150 - protein, 454 aa, Artificial Sequence
  Description of Artificial Sequence: Synthetic Chimeric Antigen Receptor sequence
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8151 - protein, 457 aa, Artificial Sequence
  Description of Artificial Sequence: Synthetic Chimeric Antigen Receptor sequence
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8152 - protein, 483 aa, Artificial Sequence
  Description of Artificial Sequence: Synthetic Chimeric Antigen Receptor sequence
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8153 - protein, 486 aa, Artificial Sequence
  Description of Artificial Sequence: Synthetic Chimeric Antigen Receptor sequence
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8154 - protein, 669 aa, Artificial Sequence
  Description of Artificial Sequence: Synthetic Chimeric Antigen Receptor sequence
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8155 - protein, 672 aa, Artificial Sequence
  Description of Artificial Sequence: Synthetic Chimeric Antigen Receptor sequence
MALPVTALLLPLALLLHAARPQVQLQESGPGLVKPSETLSLTCTVSGFSLTSYGYVHWVRQPPGKGLEWLGVIWAGGFTNYNPSLKSRLTISKDNSKNQVSLKLSSVTAADTAVYYCARRGSSYSMDYWGQGTLVTVSSGGGGSGGGGSGGGGSEIVLTQSPATLSLSPGERATLSCRASSNVSYIHWYQQKPGQAPRPWIYEISKLATGIPARFSGSGSGTDYTLTISSLEPEDFAVYYCQQWNYPLITFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8156 - protein, 455 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8157 - protein, 458 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8158 - protein, 484 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8159 - protein, 487 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8160 - protein, 670 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8161 - protein, 673 aa, Artificial Sequence
  Description of Artificial Sequence: Synthetic Chimeric Antigen Receptor sequence
MALPVTALLLPLALLLHAARPEVQLVESGGGLVKPGGSLRLSCAASGFTFSSYAMSWVRQAPGKGLEWVASISTGASAYFADSVKGRFTISRDNAKNSLYLQMNSLRAEDTAVYYCARITTSTWYFDVWGQGTTVTVSSGGGGSGGGGSGGGGSDIQMTQSPSSLSASVGDRVTITCRASQDINSYLSWFQQKPGKAPKTLIYRANRLQSGVPSRFSGSGSGQDYTLTISSLQPEDFATYYCLQYDEFPYTFGQGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8162 - protein, 346 aa, Artificial Sequence
  Description of Artificial Sequence: Synthetic Chimeric Antigen Receptor sequence
MDKDCEMKRTTLDSPLGKLELSGCEQGLHRIIFLGKGTSAADAVEVPAPAAVLGGPEPLMQATAWLNAYFHQPEAIEEFPVPALHHPVFQQESFTRQVLWKLLKVVKFGEVISYSHLAALAGNPAATAAVKTALSGNPVPILIPCHRVVQGDLDVGGYEGGLAVKEWLLAHEGHRLGKPGLGGGGGSGGGGSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8163 - protein, 497 aa, Artificial Sequence
  Description of Artificial Sequence: Synthetic Chimeric Antigen Receptor sequence
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYNNWPPYTFGQGTKVEIKRGGGGSGGGGSGGGGSQVTLKESGPTLVKPTQTLTLTCTFSGFSLNSFGVAVGWFRQPPGKALEWLGLIYWDDDRRYFPSLEGRLSITKDASDNNVVLTMMNVDPADTATYYCARTSPMVQGIANYYAMDVWGQGTTVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8164 - protein, 489 aa, Artificial Sequence
  Description of Artificial Sequence: Synthetic Chimeric Antigen Receptor sequence
MALPVTALLLPLALLLHAARPDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIKRGGGGSGGGGSGGGGSEVQLVESGGGLVKPGGSLRLSCAASGFTFSDYYMGWVRQAPGKGLKWLSYISDRAHTIYDTDSVKGRFTISRDDAKSSLYLRMNNLRVEDTAVYYCARAVGAGEGFDYWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8165 - protein, 494 aa, Artificial Sequence
  Description of Artificial Sequence: Synthetic Chimeric Antigen Receptor sequence
MALPVTALLLPLALLLHAARPQSALTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYVFGTGTKVTVLGGGGGSGGGGSGGGGSQMQLVQSGAEVKKPGASVKVSCKASGYTFSRYYIHWVRQAPGQGLEWMGLINPGGGSTNYAQKFQGRVTMTRDTSTNTVYLELSSLRSDDTAVYYCARDYGTIDARRFDFWGQGTLVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8166 - protein, 495 aa, Artificial Sequence
  Description of Artificial Sequence: Synthetic Chimeric Antigen Receptor sequence
MALPVTALLLPLALLLHAARPQSALTQPALTQPASVSGSPGQSITISCTGTSSDFGDYDYVSWYQQHPGKAPKLMIYDVSDRPSGVSNRFSGSKSGNTASLTISGLQAEDEADYFCSSFTTSSTLVFGGGTKLTVLGGGGGSGGGGSGGGGSQVQLVQSGAEVKEPGASVKVSCKASGYTFRNSGITWVRQAPGQGLEWMGWINPNSGGAMYVDNFQGRATMTRDTSINTAYMELRSLSSDDTAVYYCARGMADLIDVFDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8167 - protein, 485 aa, Artificial Sequence
  Description of Artificial Sequence: Synthetic Chimeric Antigen Receptor sequence
MALPVTALLLPLALLLHAARPDIQMTQSPSSVSASVGDRVTITCRASQGISTLLAWYQQKPGKAPKLLISSASSLQSGVPARFSGSGSGTDFTLTISSLQPEDFATYYCQQSYRAPTFGQGTKVEIKRGGGGSGGGGSGGGGSQVTLKESGPTLLKPTQTLTLTCTFSGFSLSTRGVGVGWIRQPPGQALEWLTLIYWDDDKRYSPSLKSRLTITKDTSKNQVVLTMTNMESVDTATYYCAQQTMTGAFDIWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8168 - protein, 488 aa, Artificial Sequence
  Description of Artificial Sequence: Synthetic Chimeric Antigen Receptor sequence
MALPVTALLLPLALLLHAARPETTLTQSPAFMSATPGDKVNISCKASQDIDDDLNWYQQKPGEAPILIIQEATTLVPGIPPRFSGSGFGTDFTLTINSMQSEDVAYYFCLQHDNFPPTFGQGTKVEIKRGGGGSGGGGSGGGGSQVQLQESGPGLVKSSETLSLTCTVSGGSMNNYYWSWIRQPAGKGLEWMGRIYSSGSTNYNPALKSRVTMSVDTSKNQFSLNLSSVTAADTAIYYCARASWSGTYWALFDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8169 - protein, 490 aa, Artificial Sequence
  Description of Artificial Sequence: Synthetic Chimeric Antigen Receptor sequence
MALPVTALLLPLALLLHAARPQSALTQPASVSGSPGQSITISCTGTSSDVGGYNYVSWYQQHPGKAPKLMIYDVSKRPSGVSNRFSGSKSGNTASLTISGLQAEDEADYYCSSYTGRSTVFGGGTKLTVLGGGGGSGGGGSGGGGSEVQLVQSGGDLVQPGGSLRLSCAASGFTFSSYSMNWVRQAPGKGLEWVSSISSSSSYIYYADSVKGRFTISRDNAKNSLYLQMNSLRAEDTAVYYCARGLGGWTHDAFDIWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8170 - protein, 491 aa, Artificial Sequence
  Description of Artificial Sequence: Synthetic Chimeric Antigen Receptor sequence
MALPVTALLLPLALLLHAARPQSVLTQPPSASGTPGQRVTISCSGSSSNIGSNTVNWYQQLPGTAPKLLIYSNNQRPSGVPDRFSGSKSGTSASLAIRGLQSDDEAEYYCAAWDDSLKSFVFGKGTKVTVLGGGGGSGGGGSGGGGSQVQLVQSGAEVKKPGASVKVSCKASGYTFSRYYIHWVRQAPGQGLEWMGLINPGGGSTNYAQKFQGRVTMTRDTSTNTVYLELSSLRSDDTAVYYCARDYGTIDARRFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8171 - protein, 483 aa, Artificial Sequence
  Description of Artificial Sequence: Synthetic Chimeric Antigen Receptor sequence
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSFGPGTKVDIKRGGGGSGGGGSGGGGSQVQLVQSGTEVKKPGSSVKVSCQASGGSLSSHGVSWLRQAPGQGLEWVGRIIPMFGVTDYAQKFQDRVTITADKSTSTVYMELISLGSDDTAVYFCARESRGATFEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8172 - protein, 491 aa, Artificial Sequence
  Description of Artificial Sequence: Synthetic Chimeric Antigen Receptor sequence
MALPVTALLLPLALLLHAARPQSALTQPPSASGTPGQRVTISCPGSSSNIGSNYVYWYQQLPGTAPKLLIYRNNQRPSGVPDRFSGSKSGTSATLGITGLQTGDEADYYCGTWDSSLSAYVFGTGTKVTVLGGGGGSGGGGSGGGGSQVQLQQSGAEVKKPGASVKVSCKASGYTFSRYYIHWVRRAPGQGLEWMGLINPGGGSTNYAQKFQGRVTMTRDTSTNTVYLELSSLRSDDTAVYYCARDYGTIDARRFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8173 - protein, 492 aa, Artificial Sequence
  Description of Artificial Sequence: Synthetic Chimeric Antigen Receptor sequence
MALPVTALLLPLALLLHAARPQSALTQPASVSGSPGQSITISCTGTSSDFGDYDYVSWYQQHPGKAPKLMIYDVSDRPSGVSNRFSGSKSGNTASLTISGLQAEDEADYFCSSFTTSSTLVFGGGTKLTVLGGGGGSGGGGSGGGGSQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDGDMVYDSSGPDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8174 - protein, 689 aa, Artificial Sequence
  Description of Artificial Sequence: Synthetic Chimeric Antigen Receptor sequence
TAMDFQVQIFSFLLISASVIMSREVQLVETGGGLVQPGKSLELTCATSGFTFNTAWMHWVRQSPDKRLEWIARIKDTSNNYATDYVESMKGRFTISRDDSKGSVNLQMNSLKEEDTATYYCTTDFYDGTYYWNYWGQGVMVTVSSGGGGSGGGGSGGGGSSYELIQPPSAAVTLGNTVSLTCVGDELPKRYAYWYQQKPDQSIVRVIYEDSVRPPGISDRFSGSSSGTTATLTIRDAQNEDEADYYCQSTYGDDKLYIFGGGTKLTVLGDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKFWVLVVVGGVLACYSLLVTVAFIIFWVRSKRSRLLHSDYMNMTPRRPGPTRKHYQPYAPPRDFAAYRSLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8175 - protein, 679 aa, Artificial Sequence
  Description of Artificial Sequence: Synthetic Chimeric Antigen Receptor sequence
MDFQVQIFSFLLISASVIMSRQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSGGGGSGGGGSGGGGSENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKAAALPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSSLSPGKKIYIWAPLAGTCGVLLLSLVITLYCKRGRKKLLYIFKQPFMRPVQTTQEEDGCSCRFPEEEEGGCELLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8176 - protein, 679 aa, Artificial Sequence
  Description of Artificial Sequence: Synthetic Chimeric Antigen Receptor sequence
MDFQVQIFSFLLISASVIMSRENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSAAALPAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSSLSPGKKIYIWAPLAGTCGVLLLSLVITLYCKRGRKKLLYIFKQPFMRPVQTTQEEDGCSCRFPEEEEGGCELLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8177 - protein, 458 aa, Artificial Sequence
  Description of Artificial Sequence: Synthetic Chimeric Antigen Receptor sequence
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8178 - protein, 1717 aa, Artificial Sequence [sequence omitted]

SEQ ID NO: 8179 - protein, 912 aa, Artificial Sequence
  Description of Artificial Sequence: Synthetic Chimeric Antigen Receptor sequence
SLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFVWLVWGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQNSLRAEDTAVYYCAAQDAYTGGYFDYWGQGTLVTVSSMDPATTTKPVLRTPSPVHPTGTSQPQRPEDCRPRGSVKGTGLDFACDILIGVSWFLFCLLLLVLFCLHRQNQIKQGPPRSKDEEQKPQQRPDLAVDVLERTADKANGLPEKDRETDTSALAAGSSQEVTYAQLDHWALTQRTARAVSPQSTKPMAESITYAAVARH

SEQ ID NO: 8180 - protein, 1112 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFVWLWVGGVLACYSLLVTVAFIIFVWRRVKFSRSADAPAYQQGQNQLYNELNLGRREEYDVLDKRRGRDPEGGKPRRKNPQEGLYNELQKDKMAEAYSEIGKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLNAAYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDIYWAPLAGICVALLLSLIITLICYHRSRKRVCKSGGGSFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKL

SEQ ID NO: 8181 - protein, 1114 aa, Artificial Sequence; identical to SEQ ID NO: 7085
  Description of Artificial Sequence: Synthetic Chimeric Antigen Receptor sequence

SEQ ID NO: 8182 - protein, 1363 aa, Artificial Sequence
  Description of Artificial Sequence: Synthetic Chimeric Antigen Receptor sequence
MSLPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITKAGGGGSGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSDPTTTPAPRPPTPAPTIASQPLSLRPEACRPAAGGAVHTRGLDFACDIFWVLVVVGGVLACYSLLVTVAFIIFWVRRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRRAEGRGSLLTCGDVEENPGPMAVPTQVLGLLLLWLTDARCDIQMTQSPSSLSASVGDRVTITCRASEDIYFNLVWYQQKPGKAPKLLIYDTNRLADGVPSRFSGSGSGTQYTLTISSLQPEDFATYYCQHYKNYPLTFGQGTKLEIKRSGGGGSGGGGSGGGGSGGGGSRSEVQLVESGGGLVQPGGSLRLSCAASGFTLSNYGMHWIRQAPGKGLEWVSSISLNGGSTYYRDSVKGRFTISRDNAKSTLYLQMNSLRAEDTAVYYCAAQDAYTGGYFDYWGQGTLVTVSSMDPATTTKPVLRTPSPVHPTGTSQPQRPEDCRPRGSVKGTGLDFACDILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARHRAEGRGSLLTCGDVEENPGPWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYSGGGGSFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIASGS

SEQ ID NO: 8183 - protein, 689 aa, Artificial Sequence; identical to SEQ ID NO: 8174
  Description of Artificial Sequence: Synthetic Chimeric Antigen Receptor sequence

SEQ ID NO: 8184 - protein, 489 aa, Artificial Sequence
  Description of Artificial Sequence: Synthetic Chimeric Antigen Receptor sequence
MALPVTALLLPLALLLHAARPQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8185 - protein, 461 aa, Artificial Sequence
  Description of Artificial Sequence: Synthetic Chimeric Antigen Receptor sequence
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8186 - protein, 487 aa, Artificial Sequence
  Description of Artificial Sequence: Synthetic Chimeric Antigen Receptor sequence
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8187 - protein, 490 aa, Artificial Sequence
  Description of Artificial Sequence: Synthetic Chimeric Antigen Receptor sequence
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKRTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8188 - protein, 490 aa, Artificial Sequence; identical to SEQ ID NO: 8187
  Description of Artificial Sequence: Synthetic Chimeric Antigen Receptor sequence

SEQ ID NO: 8189 - protein, 676 aa, Artificial Sequence
  Description of Artificial Sequence: Synthetic Chimeric Antigen Receptor sequence
MALPVTALLLPLALLLHAARPEVQLQQSGPDLVKPGASVKISCKASGYSFTGYYMHWVKQSHGKSLEWIGRINPNNGVTLYNQKFKDKAILTVDKSSTTAYMELRSLTSEDSAVYYCARSTMITNYVMDYWGQVTSVTVSSGGGGSGGGGSGGGGSSIVMTQTPTFLLVSAGDRVTITCKASQSVSNDVAWYQQKPGQSPTLLISYTSSRYAGVPDRFIGSGYGTDFTFTISTLQAEDLAVYFCQQDYNSPPTFGGGTKLEIKREPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8190 - protein, 455 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8191 - protein, 458 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8192 - protein, 484 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8193 - protein, 487 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8194 - protein, 670 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8195 - protein, 673 aa, Artificial Sequence
  Description of Artificial Sequence: Synthetic Chimeric Antigen Receptor sequence
MALPVTALLLPLALLLHAARPQIQLVQSGPELKKPGETVKISCKASGYTFTNFGMNWVKQGPGEGLKWMGWINTNTGEPRYAEEFKGRFAFSLETTASTAYLQINNLKNEDTATYFCARDWDGAYFFDYWGQGTTLTVSSGGGSGGGGSGGGGSSIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8196 - protein, 455 aa, Artificial Sequence
  Description of Artificial Sequence: Synthetic Chimeric Antigen Receptor sequence
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8197 - protein, 458 aa, Artificial Sequence
  Description of Artificial Sequence: Synthetic Chimeric Antigen Receptor sequence
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8198 - protein, 484 aa, Artificial Sequence
  Description of Artificial Sequence: Synthetic Chimeric Antigen Receptor sequence
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8199 - protein, 487 aa, Artificial Sequence
  Description of Artificial Sequence: Synthetic Chimeric Antigen Receptor sequence
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8200 - protein, 670 aa, Artificial Sequence
  Description of Artificial Sequence: Synthetic Chimeric Antigen Receptor sequence
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8201 - protein, 673 aa, Artificial Sequence
  Description of Artificial Sequence: Synthetic Chimeric Antigen Receptor sequence
MALPVTALLLPLALLLHAARPQVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSSGGGGSGGGGSGGGGSQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8202 - protein, 459 aa, Artificial Sequence
  Description of Artificial Sequence: Synthetic Chimeric Antigen Receptor sequence
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKGLAVSTISSFFPPGYQIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8203 - protein, 462 aa, Artificial Sequence
  Description of Artificial Sequence: Synthetic Chimeric Antigen Receptor sequence
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKGLAVSTISSFFPPGYQIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8204 - protein, 488 aa, Artificial Sequence
  Description of Artificial Sequence: Synthetic Chimeric Antigen Receptor sequence
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8205 - protein, 491 aa, Artificial Sequence
  Description of Artificial Sequence: Synthetic Chimeric Antigen Receptor sequence
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8206 - protein, 674 aa, Artificial Sequence
  Description of Artificial Sequence: Synthetic Chimeric Antigen Receptor sequence
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8207 - protein, 677 aa, Artificial Sequence
  Description of Artificial Sequence: Synthetic Chimeric Antigen Receptor sequence
MALPVTALLLPLALLLHAARPEVQLVESGGGLVQPKGSLKLSCAASGFTFNTYAMNWVRQAPGKGLEWVARIRSKSNNYATYYADSVKDRFTISRDDSQSMLYLQMNNLKTEDTAMYYCVRQWDYDVRAMNYWGQGTSVTVSSGGGGSGGGGSGGGGSDIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIKEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKIISFFLALTSTALLFLLFFLTLRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8208 - protein, 489 aa, Artificial Sequence; identical to SEQ ID NO: 8184
  Description of Artificial Sequence: Synthetic Chimeric Antigen Receptor sequence

SEQ ID NO: 8209 - protein, 730 aa, Artificial Sequence
  Description of Artificial Sequence: Synthetic Chimeric Antigen Receptor sequence
MALPVTALLLPLALLLHAARPQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8210 - protein, 491 aa, Artificial Sequence
  Description of Artificial Sequence: Synthetic Chimeric Antigen Receptor sequence
MALPVTALLLPLALLLHAARPQVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8211 - protein, 732 aa, Artificial Sequence
  Description of Artificial Sequence: Synthetic Chimeric Antigen Receptor sequence
MALPVTALLLPLALLLHAARPQVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8212 - protein, 468 aa, Artificial Sequence
  Description of Artificial Sequence: Synthetic Chimeric Antigen Receptor sequence
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8213 - protein, 709 aa, Artificial Sequence
  Description of Artificial Sequence: Synthetic Chimeric Antigen Receptor sequence
QVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCSRRPRGTMDAMDYWGQGTSVTVSSGGGGSGGGGSGGGGSDIVMTQAASSLSASLGDRVTISCRASQDISKYLNWYQQKPDGTVKLLIYYTSRLHSGVPSRFSGSGSGTDYSLTIRNLEQEDIATYFCQQVYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8214 - protein, 470 aa, Artificial Sequence
  Description of Artificial Sequence: Synthetic Chimeric Antigen Receptor sequence
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8215 - protein, 711 aa, Artificial Sequence
  Description of Artificial Sequence: Synthetic Chimeric Antigen Receptor sequence
QVTLKESGPGILKPSQTLSLTCSFSGFSLNTSGMGVGWIRQPSGKGLEWLAHIWWDDDKYYNPSLKSQLTISKDTSRNQVFLKITSVDTADSATYYCARRASHVSTVDSFDFWGQGTTLTVSSGGGGSGGGGSGGGGSDIQMTQTTSSLSASLGDRVTISCRASQDISNYLNWFQQKPDGTVKLLIYYTSRLHSGVPSKFSGSGSGTDYSLTISNLEQEDIATYFCQQGYTLPWTFGGGTKLEIKLEDPAEPKSPDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8216 - protein, 546 aa, Artificial Sequence
  Description of Artificial Sequence: Synthetic Chimeric Antigen Receptor sequence
MDFQVQIFSFLLISASVIMSRGDIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGSTSGSGKPGSGEGSEVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8217 - protein, 730 aa, Artificial Sequence; identical to SEQ ID NO: 8209
  Description of Artificial Sequence: Synthetic Chimeric Antigen Receptor sequence

SEQ ID NO: 8218 - protein, 491 aa, Artificial Sequence; identical to SEQ ID NO: 8210
  Description of Artificial Sequence: Synthetic Chimeric Antigen Receptor sequence

SEQ ID NO: 8219 - protein, 732 aa, Artificial Sequence; identical to SEQ ID NO: 8211
  Description of Artificial Sequence: Synthetic Chimeric Antigen Receptor sequence

SEQ ID NO: 8220 - protein, 468 aa, Artificial Sequence; identical to SEQ ID NO: 8212
  Description of Artificial Sequence: Synthetic Chimeric Antigen Receptor sequence

SEQ ID NO: 8221 - protein, 709 aa, Artificial Sequence; identical to SEQ ID NO: 8213
  Description of Artificial Sequence: Synthetic Chimeric Antigen Receptor sequence

SEQ ID NO: 8222 - protein, 709 aa, Artificial Sequence; identical to SEQ ID NO: 8213
  Description of Artificial Sequence: Synthetic Chimeric Antigen Receptor sequence

SEQ ID NO: 8223 - protein, 711 aa, Artificial Sequence; identical to SEQ ID NO: 8215
  Description of Artificial Sequence: Synthetic Chimeric Antigen Receptor sequence

SEQ ID NO: 8224 - protein, 726 aa, Artificial Sequence
  Description of Artificial Sequence: Synthetic Chimeric Antigen Receptor sequence
LLVTSLLLCELPHPAFLLIPDTDVKLQESGPGLVAPSQSLSITCTVSGFSLTSYAVSWVRQPPGKGLEWLGIIWSGGATNYNSALKSRLSISKDNSKSQVFLKMNGLQTDDTARYYCAREHYYGSSAMDYWGQGASITVSSGGGGSGGGGSGGGGSGIVMTQSPLSLPVSLGDQASISCRSSQSIVHSYGNTYLFWYLQKPGQSPKLLIYRVSNRFSGVPDRFSGSGSGTNFTLKISRVEAEDMGVYYCFQGTHVPYTFGGGTKLEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKKDPKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8225 - protein, 481 aa, Artificial Sequence
  Description of Artificial Sequence: Synthetic Chimeric Antigen Receptor sequence
MDFQVQIFSFLLISASVIMSRGDIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGSTSGSGKPGSGEGSEVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSAAAIEVMYPPPYLDNEKSNGTIIHVKGKHLCPSPLFPGPSKPFWVLVVVGGVLACYSLLVTVAFIIFWRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8226 - protein, 539 aa, Artificial Sequence
  Description of Artificial Sequence: Synthetic Chimeric Antigen Receptor sequence
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAATTTKPVLRTPSPVHPTGTSQPQRPEDCRPRGSVKGTGLDFACDIYIWAPLAGICVALLLSLIITLICYHRSRNSRRNRLLQVTTMNMTPRRPGLTRKPYQPYAPARDFAAYRPKWIRKKFPHIFKQPFKKTTGAAQEEDACSCRCPQEEEGGGGGYELRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 8227 - protein, 494 aa, Artificial Sequence
  Description of Artificial Sequence: Synthetic Chimeric Antigen Receptor sequence
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAATTTKPVLRTPSPVHPTGTSQPQRPEDCRPRGSVKGTGLDFACDIYIWAPLAGICVALLLSLIITLICYHRSRNSRRNRLLQVTTMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 8228 - protein, 551 aa, Artificial Sequence
  Description of Artificial Sequence: Synthetic Chimeric Antigen Receptor sequence
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8229 - protein, 487 aa, Artificial Sequence
  Description of Artificial Sequence: Synthetic Chimeric Antigen Receptor sequence
MGWSCIILFLVATATGVHSEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSSGSTSGSGKPGSGEGSDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8230 - protein, 504 aa, Artificial Sequence; identical to SEQ ID NO: 7852
  Description of Artificial Sequence: Synthetic Chimeric Antigen Receptor sequence

SEQ ID NO: 8231 - protein, 491 aa, Artificial Sequence; identical to SEQ ID NO: 7853
  Description of Artificial Sequence: Synthetic Chimeric Antigen Receptor sequence

SEQ ID NO: 8232 - protein, 614 aa, Artificial Sequence; identical to SEQ ID NO: 6864
  Description of Artificial Sequence: Synthetic Chimeric Antigen Receptor sequence

SEQ ID NO: 8233 - protein, 242 aa, Artificial Sequence; identical to SEQ ID NO: 5760
  Description of Artificial Sequence: Synthetic CD19 scFv sequence

SEQ ID NO: 8234 - protein, 45 aa, Homo sapiens; identical to SEQ ID NO: 6741

SEQ ID NO: 8235 - protein, 69 aa, Homo sapiens; identical to SEQ ID NO: 6747

SEQ ID NO: 8236 - protein, 112 aa, Homo sapiens; identical to SEQ ID NO: 6643

SEQ ID NO: 8237 - protein, 42 aa, Homo sapiens; identical to SEQ ID NO: 6577

SEQ ID NO: 8238 - protein, 9 aa, Artificial Sequence
  Description of Artificial Sequence: Synthetic Tag
YPYDVPDYA

SEQ ID NO: 8239 - protein, 20 aa, Artificial Sequence
  Description of Artificial Sequence: Synthetic Cleavage site sequence
GATNFSLLKQAGDVEENPGP

SEQ ID NO: 8240 - protein, 235 aa, Artificial Sequence
  Description of Artificial Sequence: Synthetic Payload sequence
LSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 8241 - DNA, 726 bp, Artificial Sequence
  Description of Artificial Sequence: Synthetic CD19 scFv sequence
gacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagc

SEQ ID NO: 8242 - DNA, 726 bp, Artificial Sequence
  Description of Artificial Sequence: Synthetic CD19 scFv sequence
gacatccagatgacacagaccacaagctccctgagcgcctccctgggcgacagagtgaccatctcttgccgggccagccaggatatctccaagtatctgaactggtaccagcagaagcccgatggcacagtgaagctgctgatctatcacacctctcgcctgcacagcggcgtgccttccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataactccgccctgaagtctcggctgaccatcatcaaggacaactctaagagccaggtgttcctgaagatgaattccctgcagacagacgataccgccatctactattgcgccaagcactactattacggcggctcctatgccatggattactggggccagggcacatctgtgaccgtgtctagc

SEQ ID NO: 8243 - DNA, 726 bp, Artificial Sequence
  Description of Artificial Sequence: Synthetic CD19 scFv sequence
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgaccatcatcaaggacaactctaagagccaggtgttcctgaagatgaattccctgcagacagacgataccgccatctactattgcgccaagcactactattacggcggctcttatgccatggattactggggccagggcacaagcgtgaccgtgtctagc

SEQ ID NO: 8244 - DNA, 726 bp, Artificial Sequence
  Description of Artificial Sequence: Synthetic CD19 scFv sequence
gacatccagatgacacagaccacaagctccctgagcgcctccctgggcgacagagtgaccatctcttgccgggccagccaggatatctccaagtatctgaactggtaccagcagaagccagatggcacagtgaagctgctgatctatcacacctctcgcctgcacagcggagtgccctccaggttctctggcagcggctccggcacagactactctctgaccatcagcaacctggagcaggaggatatcgccacctatttctgccagcagggcaatacactgccctacacctttggcggcggcacaaagctggagatcaccggcggcggcggctctggaggaggaggcagcggcggaggaggctccgaggtgaagctgcaggagtccggaccaggcctggtggcaccatctcagagcctgtccgtgacatgtaccgtgagcggcgtgtccctgcctgactacggcgtgagctggatcagacagccacctaggaagggcctggagtggctgggcgtgatctggggctccgagacaacatactataattccgccctgaagtctcggctgacaatcatcaaggacaactctaagagccaggtgtttctgaagatgaatagcctgcagacagacgataccgccatctactattgcgccaagcactactattacggcggctcctatgccatggattactggggccagggcacatctgtgaccgtgtctagc

SEQ ID NO: 8245 - DNA, 726 bp, Artificial Sequence
  Description of Artificial Sequence: Synthetic CD19 scFv sequence
gacatccagatgacacagaccacaagctccctgagcgcctccctgggcgacagagtgaccatcagctgccgggcctcccaggatatctctaagtatctgaactggtaccagcagaagccagatggcacagtgaagctgctgatctatcacaccagccgcctgcactccggagtgccctctaggttctctggcagcggctccggcacagactacagcctgaccatctccaacctggagcaggaggatatcgccacctatttctgccagcagggcaatacactgccatacacctttggcggcggcacaaagctggagatcaccggaggaggaggcagcggaggaggaggctccggcggcggcggctctgaggtgaagctgcaggagtccggaccaggcctggtggcaccttctcagagcctgtccgtgacatgtaccgtgtctggcgtgagcctgcccgactacggcgtgtcttggatcagacagccacctaggaagggcctggagtggctgggcgtgatctggggcagcgagacaacatactataattctgccctgaagagcaggctgacaatcatcaaggacaactctaagagccaggtgtttctgaagatgaatagcctgcagacagacgataccgccatctactattgtgccaagcactactattacggcggcagctatgccatggattactggggccagggcacatccgtgaccgtgtctagc

SEQ ID NO: 8246 - DNA, 726 bp, Artificial Sequence
  Description of Artificial Sequence: Synthetic CD19 scFv sequence
gacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctca

SEQ ID NO: 8247 - DNA, 135 bp, Artificial Sequence
  Description of Artificial Sequence: Synthetic Construct
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgat

SEQ ID NO: 8248 - DNA, 135 bp, Artificial Sequence
  Description of Artificial Sequence: Synthetic Construct
acaacaaccccagcacccagacctccaacacctgcaccaaccatcgcaagccagcctctgtccctgaggcccgaggcatgtaggccagcagcaggaggcgccgtgcacacccggggcctggactttgcctgcgat

SEQ ID NO: 8249 - DNA, 135 bp, Artificial Sequence
  Description of Artificial Sequence: Synthetic Construct
accacaaccccagcaccccgcccaccaacacctgcaccaaccatcgcctcccagccactgtctctgaggcccgaggcatgtaggcctgcagcaggaggcgccgtgcacaccaggggcctggactttgcctgcgat

SEQ ID NO: 8250 - DNA, 135 bp, Artificial Sequence
  Description of Artificial Sequence: Synthetic Construct
accacaaccccagcacccagaccaccaacacctgcaccaaccatcgcaagccagcctctgtccctgcgcccagaggcatgcaggccagcagcaggaggagcagtgcacacccggggcctggacttcgcatgtgat

SEQ ID NO: 8251 - DNA, 135 bp, Artificial Sequence
  Description of Artificial Sequence: Synthetic Construct
accacaaccccagcacctcgcccaccaacaccagcaccaaccatcgcatcccagccactgtctctgcgccccgaggcatgcaggcctgcagcaggcggcgccgtgcacaccaggggcctggacttcgcctgtgat

SEQ ID NO: 8252 - DNA, 207 bp, Artificial Sequence
  Description of Artificial Sequence: Synthetic Construct
accacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgc

SEQ ID NO: 8253 - DNA, 207 bp, Artificial Sequence
  Description of Artificial Sequence: Synthetic Construct
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgc

SEQ ID NO: 8254 - DNA, 207 bp, Artificial Sequence
  Description of Artificial Sequence: Synthetic Construct
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcactttactgccc

SEQ ID NO: 8255 - DNA, 338 bp, Artificial Sequence
  Description of Artificial Sequence: Synthetic Construct
agggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtg

SEQ ID NO: 8256 - DNA, 338 bp, Artificial Sequence
  Description of Artificial Sequence: Synthetic Construct
agggtgaagttttccaggtctgccgatgcccccgcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 8257 - DNA, 338 bp, Artificial Sequence
  Description of Artificial Sequence: Synthetic Construct
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctacagcgagatcggcatgaagggagagaggagacggggcaagggacacgatggcctgtatcagggcctgtccacagccaccaaggacacctacgatgcactgcacatgcaggccctgcctccaaggtg

SEQ ID NO: 8258 - DNA, 338 bp, Artificial Sequence
  Description of Artificial Sequence: Synthetic Construct
agggtgaagttttccaggtctgccgatgccccagcctataagcagggccagaatcagctgtacaacgagctgaatctgggcaggagagaggagtacgacgtgctggataagaggaggggacgcgaccccgagatgggaggcaagcctaggagaaagaacccacaggagggcctgtataatgagctgcagaaggacaagatggccgaggcctactctgagatcggcatgaagggagagcggcgcaggggcaagggacacgatggcctgtatcagggcctgagcacagccaccaaggacacctacgatgcactgcacatgcaggccctgccacctaggtg

SEQ ID NO: 8259 - DNA, 338 bp, Artificial Sequence
  Description of Artificial Sequence: Synthetic Construct
agggtgaagtttagcaggtccgccgatgccccagcctataagcagggccagaaccagctgtacaacgagctgaatctgggcaggagggaagagtacgacgtgctggataagaggagaggaagggaccccgagatgggaggcaagccaaggaggaagaacccacaggagggcctgtataatgagctgcagaaggacaagatggccgaggcctactccgagatcggcatgaagggagagaggagacggggcaagggacacgatggcctgtatcagggcctgtctacagccaccaaggacacctacgatgcactgcacatgcaggccctgcctccaaggtg

SEQ ID NO: 8260 - DNA, 336 bp, Artificial Sequence
  Description of Artificial Sequence: Synthetic Construct
agggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaagg

SEQ ID NO: 8261 - DNA, 336 bp, Artificial Sequence
  Description of Artificial Sequence: Synthetic Construct
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 8262 - DNA, 126 bp, Artificial Sequence
  Description of Artificial Sequence: Synthetic Construct
aagagaggccggaagaagctgctgtacatcttcaagcagcccttcatgaggcccgtgcagacaacccaggaggaggacggctgcagctgtcggttcccagaggaggaggagggaggatgtgagctg

SEQ ID NO: 8263 - DNA, 126 bp, Artificial Sequence
  Description of Artificial Sequence: Synthetic Construct
aagcgcggcaggaagaagctgctgtacatcttcaagcagccctttatgcgccctgtgcagacaacccaggaggaggacggctgcagctgtaggttcccagaggaggaggagggaggatgtgagctg

SEQ ID NO: 8264 - DNA, 126 bp, Artificial Sequence
  Description of Artificial Sequence: Synthetic Construct
aagcgcggcaggaagaagctgctgtacatcttcaagcagccttttatgcgcccagtgcagacaacccaggaggaggacggctgcagctgtaggttccctgaggaggaggagggaggatgtgagctg

SEQ ID NO: 8265 - DNA, 126 bp, Artificial Sequence
  Description of Artificial Sequence: Synthetic Construct
aagcgcggcaggaagaagctgctgtacatcttcaagcagccctttatgcgccctgtgcagacaacccaggaggaggacggctgcagctgtaggttccctgaggaggaggagggaggatgtgagctg

SEQ ID NO: 8266 - DNA, 126 bp, Artificial Sequence
  Description of Artificial Sequence: Synthetic Construct
aagcgcggcaggaagaagctgctgtacatcttcaagcagccttttatgcgcccagtgcagacaacccaggaggaggacggctgcagctgtaggttccctgaggaggaggagggaggatgcgagctg

SEQ ID NO: 8267 - DNA, 126 bp, Artificial Sequence
  Description of Artificial Sequence: Synthetic Construct
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 8268 - DNA, 27 bp, Artificial Sequence
  Description of Artificial Sequence: Synthetic Tag
tatccttacgatgtgcccgactatgct

SEQ ID NO: 8269 - DNA, 705 bp, Artificial Sequence
  Description of Artificial Sequence: Synthetic Cleavage site sequence
ttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaag

SEQ ID NO: 8270 - DNA, 60 bp, Artificial Sequence
  Description of Artificial Sequence: Synthetic Payload sequence
ggagctactaacttcagcctgctgaagcaggctggagacgtggaggagaaccctggacct

SEQ ID NO: 8271 - protein, 486 aa, Artificial Sequence; identical to SEQ ID NO: 7333
  Description of Artificial Sequence: Synthetic polypeptide

SEQ ID NO: 8272 - protein, 815 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACNLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8273 - protein, 815 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8274 - protein, 815 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8275 - protein, 823 aa, Artificial Sequence
  Description of Artificial Sequence: Synthetic polypeptide
MALPVTALLLPLALLLHAARPYPYDVPDYADIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8276 - protein, 823 aa, Artificial Sequence
  Description of Artificial Sequence: Synthetic polypeptide
MALPVTALLLPLALLLHAARPYPYDVPDYADIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8277 - protein, 1051 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGSLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 8278 - protein, 1072 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGSGGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 8279 - protein, 1082 aa, Artificial Sequence
  Description of Artificial Sequence: Synthetic polypeptide
MALPVTALLLPLALLLHAARPYPYDVPDYADIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGSLDGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 8280 - protein, 1082 aa, Artificial Sequence
  Description of Artificial Sequence: Synthetic polypeptide
MALPVTALLLPLALLLHAARPYPYDVPDYADIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQGSLDGATNFSLLKQAGDVEENPGPLSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 8281 - protein, 814 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8282 - protein, 814 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8283 - protein, 814 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSADLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8284 - protein, 814 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACALSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8285 - DNA, 1461 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 8286 - DNA, 2448 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatccggagaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtaatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtag

SEQ ID NO: 8287 - DNA, 2448 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatccggagaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtag

SEQ ID NO: 8288 - DNA, 2448 bp, Artificial Sequence
  Description of Artificial Sequence: Synthetic polynucleotide
atggcactgcctgtgaccgccctgctgctgccactggccctgctgctgcacgcagccaggcccgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatccggagaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtag

SEQ ID NO: 8289 - DNA, 2472 bp, Artificial Sequence
  Description of Artificial Sequence: Synthetic polynucleotide
atggcactgcctgtgaccgccctgctgctgccactggccctgctgctgcacgcagccaggccctatccttacgatgtgcccgactatgctgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtcaggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtag

SEQ ID NO: 8290 - DNA, 2472 bp, Artificial Sequence
  Description of Artificial Sequence: Synthetic polynucleotide
atggcactgcctgtgaccgccctgctgctgccactggccctgctgctgcacgcagccaggccctatccttacgatgtgcccgactatgctgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggtcaggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtag

SEQ ID NO: 8291 - DNA, 3156 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggatcattgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 8292 - DNA, 3219 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggatccggaggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 8293 - DNA, 3249 bp, Artificial Sequence
  Description of Artificial Sequence: Synthetic polynucleotide
atggcactgcctgtgaccgccctgctgctgccactggccctgctgctgcacgcagccaggccctatccttacgatgtgcccgactatgctgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggtagtctagatggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 8294 - DNA, 3249 bp, Artificial Sequence
  Description of Artificial Sequence: Synthetic polynucleotide
atggcactgcctgtgaccgccctgctgctgccactggccctgctgctgcacgcagccaggccctatccttacgatgtgcccgactatgctgacatccagatgacacagaccacaagctccctgtccgcctctctgggcgacagagtgaccatcagctgccgggcctcccaggatatctctaagtatctgaactggtaccagcagaagcccgatggcacagtgaagctgctgatctatcacaccagccgcctgcactccggagtgccttctaggttcagcggctccggctctggcacagactacagcctgaccatctccaacctggagcaggaggatatcgccacctatttctgccagcagggcaatacactgccttacacctttggcggcggcacaaagctggagatcaccggaggaggaggcagcggaggaggaggctccggcggcggcggctctgaggtgaagctgcaggagtccggaccaggcctggtggcacctagccagtccctgtctgtgacatgtaccgtgtccggcgtgtctctgccagactacggcgtgtcttggatcaggcagccacctaggaagggcctggagtggctgggcgtgatctggggcagcgagacaacatactataattctgccctgaagagcagactgacaatcatcaaggacaacagcaagtcccaggtgttcctgaagatgaatagcctgcagacagacgataccgccatctactattgcgccaagcactactattacggcggcagctatgccatggattactggggccagggcacatccgtgaccgtgtctagcaccacaaccccagcacctcgcccaccaacaccagcaccaaccatcgcatcccagccactgtctctgaggcccgaggcatgtaggcctgcagcaggaggcgccgtgcacaccaggggcctggactttgcctgcgatatctatatctgggcaccactggcaggaacatgtggcgtgctgctgctgtccctggtcatcaccctgtattgcaagagaggccggaagaagctgctgtacatcttcaagcagcccttcatgaggcccgtgcagacaacccaggaggaggacggctgcagctgtcggttcccagaggaggaggagggaggatgtgagctgagggtgaagttttctaggagcgccgatgcaccagcatataagcagggacagaaccagctgtacaacgagctgaatctgggcaggagagaggagtacgacgtgctggataagaggaggggaagggaccccgagatgggaggcaagccaaggagaaagaacccccaggagggcctgtataatgagctgcagaaggacaagatggccgaggcctactccgagatcggcatgaagggagagcggcgcaggggcaagggacacgatggcctgtatcagggcctgtctacagccaccaaggacacctacgatgcactgcacatgcaggccctgcctccaaggggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagggtagtctagatggagctactaacttcagcctgctgaagcaggctggagacgtggaggagaaccctggacctttgagcaagggcgaggaggacaacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgccgaggtcaagaccacctacaaggccaagaagcccgtgcagctgcccggcgcctacaacgtcaacatcaagctggacatcacctcccacaacgaggactacaccatcgtggaacagtacgagcgcgccgagggccgccactccaccggcggcatggacgagctgtacaagtaa

SEQ ID NO: 8295 - DNA, 2445 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8296 - DNA, 2445 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8297 - DNA, 2445 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagcgccgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8298 - DNA, 2445 bp, Artificial Sequence
  Description of Artificial Sequence: Synthetic polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgccctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8299 - protein, 133 aa, Homo sapiens [sequence omitted]

SEQ ID NO: 8300 - DNA, 402 bp, Homo sapiens
gcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttga

SEQ ID NO: 8301 - DNA, 402 bp, Artificial Sequence
  Description of Artificial Sequence: Synthetic polynucleotide
gcgccaactagtagcagcacaaaaaagacacagcttcaactggagcacctgctgctggacctgcagatgatccttaacggaatcaacaactacaagaaccccaagctgaccaggatgctgacgtttaagttttacatgcccaagaaggccaccgaactcaaacacctgcaatgcctggaggaagagctgaaaccgcttgaggaagtgttgaacctggcccaaagcaagaatttccacctgaggcccagggacctgataagcaacatcaacgtgatcgtgctggaactgaagggtagcgagaccaccttcatgtgcgagtacgccgacgagaccgcaaccatcgtggagttcctgaaccgatggataacattctgccagagcatcattagcactctgacctga

SEQ ID NO: 8302 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 8303 - DNA, 921 bp, Homo sapiens
atatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttag

SEQ ID NO: 8304 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtaggaagaacgcctccatctctgtgagggcccaggatcgctactattcctctagctggtccgagtgggcctctgtgccctgtagc

SEQ ID NO: 8305 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacaccagaggaggatggcatcacctggacactggatcagtctagcgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtcctctaggggcagctccgacccccagggcgtgacatgcggagcagccaccctgtccgccgagagggtgcgcggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatccgggacatcatcaagcccgatccacccaagaacctgcagctgaagcctctgaagaattctagacaggtggaggtgagctgggagtacccagacacctggtccacaccccactcttatttcagcctgaccttttgcgtgcaggtgcagggcaagtccaagagggagaagaaggaccgcgtgttcaccgataagacatctgccaccgtgatctgtaggaagaacgcctccatctctgtgagggcccaggatcgctactattcctctagctggtccgagtgggcctctgtgccctgtagc

SEQ ID NO: 8306 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagtctagcgaggtgctgggctccggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattatagcggccgctttacctgttggtggctgaccacaatcagcaccgatctgacattttccgtgaagtcctctaggggcagctccgacccccagggcgtgacatgcggagcagccaccctgtccgccgagcgggtgagaggcgataacaaggagtacgagtattccgtggagtgccaggaggactctgcctgtccagcagcagaggagagcctgcctatcgaagtgatggtggatgccgtgcacaagctgaagtacgagaattatacatctagcttctttatcagggacatcatcaagcccgatccacccaagaacctgcagctgaagcctctgaagaattctcgccaggtggaggtgagctgggagtacccagacacctggagcacaccccactcttatttcagcctgaccttttgcgtgcaggtgcagggcaagtctaagcgggagaagaaggacagagtgttcaccgataagacaagcgccaccgtgatctgtcggaagaacgcctccatctctgtgcgggcccaggatagatactattcctctagctggtccgagtgggcctctgtgccctgtagc

SEQ ID NO: 8307 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgaggtgcgaggccaagaattatagcggccgctttacctgttggtggctgaccacaatcagcaccgatctgacattttccgtgaagtctagcagaggctcctctgacccccagggcgtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagagcaagagggagaagaaggaccgcgtgttcaccgataagacatccgccaccgtgatctgtcggaagaacgcctccatctctgtgcgggcccaggatagatactattctagctcctggtccgagtgggcctctgtgccctgtagc

SEQ ID NO: 8308 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggaagcggcaagaccctgacaatccaggtgaaggagttcggcgacgccggccagtacacatgtcacaagggcggcgaggtgctgtctcacagcctgctgctgctgcacaagaaggaggacggcatttggtccacagacatcctgaaggatcagaaggagccaaagaacaagaccttcctgcggtgcgaggccaagaattatagcggccggttcacctgttggtggctgaccacaatcagcaccgatctgacattttccgtgaagtctagccggggctcctctgacccacagggagtgacatgcggagcagccaccctgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctcgccaggtggaggtgagctgggagtacccagacacctggtccacaccccactcttatttcagcctgaccttttgcgtgcaggtgcagggcaagtccaagcgggagaagaaggacagagtgttcaccgataagacatctgccaccgtgatctgtcggaagaacgcctccatctctgtgagggcccaggatcgctactattctagctcctggagcgagtgggcatccgtgccatgttct

SEQ ID NO: 8309 - DNA, 918 bp, Artificial Sequence
  Description of Artificial Sequence: Synthetic polynucleotide
atctgggagctcaagaaagacgtgtacgtggtggaactggactggtaccccgacgcccctggcgaaatggtggtgctgacatgcgacacccctgaggaggatggcattacctggaccctcgatcagagctccgaggtgctgggcagcggcaaaaccctgaccatccaggtgaaggagtttggcgatgccggccagtacacatgtcacaagggcggcgaggtgctgagccactccctgctgctgctccacaagaaggaagatggcatctggagcaccgacattctgaaggatcagaaggagcccaagaacaagacattcctgaggtgtgaggccaagaactacagcggcaggtttacctgctggtggctgacaacaatcagcaccgacctcacattctccgtcaagtcctccaggggttcttccgaccctcaaggcgtgacatgcggcgctgccaccctgagcgctgagagagtcaggggcgacaacaaggagtacgagtacagcgtcgaatgtcaggaggacagcgcctgtcccgccgctgaagagagcctgcctatcgaggtgatggtggacgccgtgcacaaactgaagtatgagaattacacctccagcttcttcatcagggacatcatcaaacccgatccccccaagaacctgcagctgaagcctctgaagaacagcagacaggtcgaagtgtcctgggagtaccctgatacctggtccacaccccacagctacttcagcctgaccttttgcgtgcaggtgcagggcaagagcaaaagggagaagaaggacagggtgtttaccgacaagacctccgccacagtgatttgcagaaagaacgcctccatcagcgtgagggcccaggacaggtattacagcagctcctggagcgaatgggctagcgtgccctgtagc

SEQ ID NO: 8310 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacccgaggaggatggcatcacctggacactggatcagtctagcgaggtgctgggctccggcaagaccctgacaatccaggtgaaggagttcggcgacgccggccagtacacctgtcacaagggcggcgaggtgctgtcccactctctgctgctgctgcacaagaaggaggacggcatctggtctacagacatcctgaaggatcagaaggagcctaagaacaagaccttcctgcggtgcgaggccaagaattatagcggccggttcacctgttggtggctgaccacaatcagcaccgatctgacattttccgtgaagtcctctcggggcagctccgacccacagggagtgacatgcggagcagccaccctgtccgccgagagggtgcgcggcgataacaaggagtacgagtattccgtggagtgccaggaggactctgcctgtccagcagcagaggagagcctgccaatcgaagtgatggtggatgccgtgcacaagctgaagtacgagaattatacatctagcttctttatccgggacatcatcaagcccgatccccctaagaacctgcagctgaagcctctgaagaattctagacaggtggaggtgagctgggagtaccccgacacctggagcacacctcacagctatttctccctgaccttttgcgtgcaggtgcagggcaagtccaagagggagaagaaggaccgcgtgttcaccgataagacatctgccaccgtgatctgtcggaagaacgccagcatctccgtgagggcccaggatcgctactattcctctagctggtctgagtgggccagcgtgccctgttcc

SEQ ID NO: 8311 - DNA, 918 bp, Artificial Sequence
  Description of Artificial Sequence: Synthetic polynucleotide
atctgggagctgaagaaggacgtgtacgtggtggagctggactggtatcctgatgccccaggcgagatggtggtgctgacatgcgacacccccgaggaggatggcatcacatggaccctggatcagtcctctgaggtgctgggctccggcaagacactgaccatccaggtgaaggagttcggcgacgccggccagtacacctgtcacaagggaggagaggtgctgagccactccctgctgctgctgcacaagaaggaggacggcatctggtccaccgacatcctgaaggatcagaaggagcccaagaacaagacattcctgagatgcgaggccaagaattatagcggcaggtttacctgttggtggctgacaaccatctccacagatctgaccttttctgtgaagagctcccggggctctagcgaccctcagggagtgacctgcggagcagccacactgtccgccgagcgggtgagaggcgataacaaggagtacgagtattccgtggagtgccaggaggactctgcctgtcctgcagcagaggagagcctgccaatcgaagtgatggtggatgccgtgcacaagctgaagtacgagaattatacctcctctttctttatcagagacatcatcaagccagatcctccaaagaacctgcagctgaagcccctgaagaatagcaggcaggtggaggtgtcctgggagtacccagacacatggagcaccccccacagctatttctccctgacattttgcgtgcaggtgcagggcaagtccaagcgcgagaagaaggaccgggtgttcacagataagacctctgccacagtgatctgtcgcaagaacgcctctatcagcgtgcgcgcccaggatcggtactatagctcctcttggtctgagtgggccagcgtgccttgttcc

SEQ ID NO: 8312 - DNA, 918 bp, Artificial Sequence
  Description of Artificial Sequence: Synthetic polynucleotide
atctgggagctgaagaaggacgtgtacgtggtggagctggactggtatcccgatgcccctggcgagatggtggtgctgacctgcgacacacctgaggaggatggcatcacctggacactggatcagagctccgaggtgctgggcagcggcaagaccctgacaatccaggtgaaggagttcggcgacgccggccagtacacatgtcacaagggcggcgaggtgctgtctcacagcctgctgctgctgcacaagaaggaggacggcatctggtccacagacatcctgaaggatcagaaggagccaaagaacaagaccttcctgaggtgcgaggccaagaattattctggcaggttcacctgttggtggctgaccacaatcagcaccgatctgacattttccgtgaagtctagccggggctcctctgacccccagggagtgacatgcggagcagccaccctgtccgccgagagggtgagaggcgataacaaggagtacgagtattccgtggagtgccaggaggactctgcctgtcctgcagcagaggagagcctgccaatcgaagtgatggtggatgccgtgcacaagctgaagtacgagaattatacaagctccttctttatcagggacatcatcaagcctgatccccctaagaacctgcagctgaagccactgaagaattctagacaggtggaggtgagctgggagtacccagacacctggagcacaccccactcctatttctctctgaccttttgcgtgcaggtgcagggcaagagcaagagggagaagaaggacagagtgttcaccgataagacatccgccaccgtgatctgtcggaagaacgcctccatctctgtgcgggcccaggatcgctactattctagctcctggagcgagtgggcatccgtgccatgttct

SEQ ID NO: 8313 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 8314 - DNA, 594 bp, Homo sapiens
agaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 8315 - DNA, 594 bp, Artificial Sequence
  Description of Artificial Sequence: Synthetic polynucleotide
cgcaatctgccagtggccacccctgacccaggcatgttcccctgcctgcaccacagccagaacctgctgagggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctcttga

SEQ ID NO: 8316 - DNA, 591 bp, Artificial Sequence
  Description of Artificial Sequence: Synthetic polynucleotide
cgcaatctgccagtggccacccctgacccaggcatgttcccctgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagtcctgtctgaacagccgggaaaccagcttcatcaccaacggctcctgcctggcctctcgcaagaccagcttcatgatggccctgtgcctgtcctctatctacgaggacctgaagatgtatcaggtggagttcaagaccatgaacgccaagctgctgatggaccctaagcggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttcggatcagagccgtgaccatcgacagagtgatgtcctatctgaatgcctct

SEQ ID NO: 8317 - DNA, 594 bp, Artificial Sequence
  Description of Artificial Sequence: Synthetic polynucleotide
agaaatctgccagtggccacccctgacccaggcatgttcccctgcctgcaccactctcagaacctgctgcgggccgtgagcaatatgctgcagaaggccagacagacactggagttttacccttgtacctccgaggagatcgaccacgaggatatcacaaaggataagacctctacagtggaggcctgcctgccactggagctgaccaagaacgagtcctgtctgaacagccgggaaaccagcttcatcaccaacggctcctgcctggcctctagaaagaccagcttcatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagagctccctggaggagcccgatttctacaagaccaagatcaagctgtgcatcctgctgcacgcctttaggatccgcgccgtgaccatcgaccgcgtgatgtcctatctgaatgcctcttga

SEQ ID NO: 8318 - DNA, 591 bp, Artificial Sequence
  Description of Artificial Sequence: Synthetic polynucleotide
agaaatctgccagtggcaacccctgacccaggaatgttcccttgcctgcaccacagccagaacctgctgcgggccgtgtccaatatgctgcagaaggccagacagacactggagttttacccttgtacctctgaggagatcgaccacgaggatatcacaaaggataagaccagcacagtggaggcctgcctgccactggagctgaccaagaacgagtcctgtctgaacagccgggaaaccagcttcatcaccaacggctcctgcctggcctctcgcaagaccagcttcatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgacagagtgatgtcctatctgaacgcctct

SEQ ID NO: 8319 - DNA, 591 bp, Artificial Sequence
  Description of Artificial Sequence: Synthetic polynucleotide
agaaatctgccagtggcaacccctgacccaggaatgttcccttgcctgcaccacagccagaacctgctgagggccgtgtccaatatgctgcagaaggcccgccagacactggagttttacccttgtaccagcgaggagatcgaccacgaggatatcacaaaggataagacctccacagtggaggcctgcctgccactggagctgaccaagaacgagagctgtctgaattcccgggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaatagcgagacagtgccacagaagtcctctctggaggagcccgatttctacaagaccaagatcaagctgtgcatcctgctgcacgcctttaggatccgcgccgtgaccatcgaccgcgtgatgtcttatctgaacgcatcc

SEQ ID NO: 8320 - DNA, 591 bp, Artificial Sequence
  Description of Artificial Sequence: Synthetic polynucleotide
agaaacctgcctgtcgctacccccgaccccggaatgttcccctgcctgcaccactcccagaacctcctgagggccgtgtccaacatgctgcagaaggctagacagaccctcgaattctacccctgtaccagcgaggagatcgaccatgaggacatcaccaaggataagaccagcaccgtggaggcttgcctgcctctggagctgaccaaaaacgagagctgcctgaacagcagggaaaccagcttcattaccaacggctcctgcctggcctccaggaagacatccttcatgatggccctgtgcctcagcagcatctacgaggacctgaagatgtatcaggtggagtttaagaccatgaatgccaagctgctgatggaccctaagaggcagatcttcctggaccagaatatgctggccgtgattgacgagctgatgcaggccctcaactttaacagcgagaccgtgccccagaaaagcagcctcgaagagcctgacttctacaaaaccaagattaagctgtgtatcctgctgcacgccttcaggatcagggccgtgaccatcgacagggtgatgagctacctgaacgccagc

SEQ ID NO: 8321 - DNA, 591 bp, Artificial Sequence
  Description of Artificial Sequence: Synthetic polynucleotide
agaaatctgccagtggccacccctgacccaggcatgttcccctgcctgcaccacagccagaacctgctgagggccgtgtccaatatgctgcagaaggcccgccagacactggagttttacccctgtaccagcgaggagatcgaccacgaggatatcacaaaggataagacctccacagtggaggcctgcctgcctctggagctgaccaagaacgagtcttgtctgaatagcagggagacatccttcatcaccaacggctcttgcctggccagccgcaagacatcctttatgatggccctgtgcctgtcctctatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgcctcagaagagctccctggaggagccagatttctacaagaccaagatcaagctgtgcatcctgctgcacgcctttcggatcagagccgtgaccatcgaccgcgtgatgtcttatctgaatgccagc

SEQ ID NO: 8322 - DNA, 591 bp, Artificial Sequence
  Description of Artificial Sequence: Synthetic polynucleotide
cggaatctgcctgtggcaacccccgaccctggaatgttcccatgcctgcaccacagccagaacctgctgcgcgccgtgtccaatatgctgcagaaggcccggcagaccctggagttttacccatgtacaagcgaggagatcgaccacgaggatatcaccaaggataagacatccaccgtggaggcatgcctgccactggagctgacaaagaacgagtcttgtctgaacagccgggagacaagcttcatcacaaacggctcttgcctggccagccggaagacctcctttatgatggccctgtgcctgagctccatctacgaggacctgaagatgtatcaggtggagttcaagacaatgaacgccaagctgctgatggaccccaagcgccagatctttctggatcagaatatgctggccgtgatcgacgagctgatgcaggccctgaactttaatagcgagacagtgccccagaagtctagcctggaggagcctgatttctacaagacaaagatcaagctgtgcatcctgctgcacgccttccggatcagagccgtgaccatcgacagagtgatgtcttatctgaatgccagc

SEQ ID NO: 8323 - DNA, 591 bp, Artificial Sequence
  Description of Artificial Sequence: Synthetic polynucleotide
cgcaatctgccagtggcaacccctgacccaggaatgttcccttgcctgcaccacagccagaacctgctgcgggccgtgtccaatatgctgcagaaggcccgccagacactggagttttacccttgtacctctgaggagatcgaccacgaggatatcacaaaggataagaccagcacagtggaggcctgcctgccactggagctgaccaagaacgagagctgtctgaattccagggagacatctttcatcaccaacggcagctgcctggcctccagaaagacatcttttatgatggccctgtgcctgtctagcatctacgaggacctgaagatgtatcaggtggagttcaagaccatgaacgccaagctgctgatggaccctaagaggcagatctttctggatcagaatatgctggccgtgatcgacgagctgatgcaggccctgaacttcaattccgagacagtgccacagaagtcctctctggaggagcccgatttctacaagaccaagatcaagctgtgcatcctgctgcacgccttcaggatcagggccgtgaccatcgacagagtgatgagctatctgaacgccagc

SEQ ID NO: 8324 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 8325 - DNA, 345 bp, Homo sapiens
aactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttga

SEQ ID NO: 8326 - DNA, 342 bp, Artificial Sequence
  Description of Artificial Sequence: Synthetic polynucleotide
aactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttct

SEQ ID NO: 8327 - DNA, 345 bp, Artificial Sequence
  Description of Artificial Sequence: Synthetic polynucleotide
aactgggtgaacgtgatctccgacctgaagaagatcgaggacctgatccagtccatgcacatcgacgccaccctgtacaccgagagcgacgtgcaccctagctgcaaggtgaccgccatgaagtgcttcctgctggagctgcaggtgatcagcctggagagcggcgatgccagcatccacgacacagtggagaacctgatcatcctggccaacaacagcctgagcagcaacggcaatgtgaccgagagcggctgcaaggagtgcgaggagctggaggagaagaacatcaaggagttcctgcagtccttcgtgcacatcgtgcagatgttcatcaacaccagctaa

SEQ ID NO: 8328 - DNA, 345 bp, Artificial Sequence
  Description of Artificial Sequence: Synthetic polynucleotide
aactgggtcaacgtgatcagcgacctgaagaagatcgaggacctcatccagtccatgcacattgacgccaccctgtacaccgagtccgatgtgcaccctagctgcaaggtgaccgccatgaaatgcttcctgctggagctgcaggtcatctccttagaaagcggcgatgcctccatccacgacaccgtggagaacctgatcatcctggccaataactccctgagcagcaacggcaacgtgaccgagagcggctgcaaagagtgtgaagagctggaggagaagaacattaaggagttcctgcagagcttcgtgcacatcgtgcaaatgttcatcaacaccagctaa

SEQ ID NO: 8329 - protein, 237 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 8330 - protein, 6 aa, Artificial Sequence
  Description of Artificial Sequence: Synthetic Linker
GSGSGS

SEQ ID NO: 8331 - protein, 8 aa, Artificial Sequence
  Description of Artificial Sequence: Synthetic Linker
GSGSGSGS

SEQ ID NO: 8332 - protein, 10 aa, Artificial Sequence
  Description of Artificial Sequence: Synthetic Linker
GSGSGGGSGS

SEQ ID NO: 8333 - protein, 8 aa, Artificial Sequence
  Description of Artificial Sequence: Synthetic Tag
DYKDDDDK

SEQ ID NO: 8334 - protein, 723 aa, Artificial Sequence
  Description of Artificial Sequence: Synthetic Construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8335 - protein, 963 aa, Artificial Sequence
  Description of Artificial Sequence: Synthetic Construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYKSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8336 - protein, 963 aa, Artificial Sequence
  Description of Artificial Sequence: Synthetic Construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFAELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQSGVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 8337 - protein, 735 aa, Artificial Sequence
  Description of Artificial Sequence: Synthetic Construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGESRRVRRNKRSKEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8338 - protein, 723 aa, Artificial Sequence
  Description of Artificial Sequence: Synthetic Construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8339 - protein, 723 aa, Artificial Sequence
  Description of Artificial Sequence: Synthetic Construct
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSGEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8340 - protein, 723 aa, Artificial Sequence; identical to SEQ ID NO: 8339
  Description of Artificial Sequence: Synthetic Construct

SEQ ID NO: 8341 - protein, 744 aa, Artificial Sequence
  Description of Artificial Sequence: Synthetic Construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGSGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8342 - protein, 746 aa, Artificial Sequence
  Description of Artificial Sequence: Synthetic Construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGSGSGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8343 - protein, 748 aa, Artificial Sequence
  Description of Artificial Sequence: Synthetic Construct
MDWTWILFLVAAATRVHSDYKDDDDKNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQYPYDVPDYAITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLGSGSGGGSGSEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRLGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 8344 - DNA, 342 bp, Artificial Sequence
  Description of Artificial Sequence: Synthetic Payload sequence
aactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 8345 - DNA, 714 bp, Homo sapiens
atcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatga

SEQ ID NO: 8346 - DNA, 711 bp, Artificial Sequence
  Description of Artificial Sequence: Synthetic Payload sequence
attacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttg

SEQ ID NO: 8347 - DNA, 18 bp, Artificial Sequence
  Description of Artificial Sequence: Synthetic Linker
ggatcaggttccggatcc

SEQ ID NO: 8348 - DNA, 24 bp, Artificial Sequence
  Description of Artificial Sequence: Synthetic Linker
ggatctggttccggatcaggatcc

SEQ ID NO: 8349 - DNA, 30 bp, Artificial Sequence
  Description of Artificial Sequence: Synthetic Linker
ggatcaggttccggaggtggatctggatcc

SEQ ID NO: 8350 - DNA, 24 bp, Artificial Sequence
  Description of Artificial Sequence: Synthetic Tag
gactacaaagacgatgacgacaag

SEQ ID NO: 8351 - DNA, 27 bp, Artificial Sequence
  Description of Artificial Sequence: Synthetic Tag
tacccatacgatgttccagattacgct

SEQ ID NO: 8352 - DNA, 2172 bp, Artificial Sequence
  Description of Artificial Sequence: Synthetic Construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8353 - DNA, 2892 bp, Artificial Sequence
  Description of Artificial Sequence: Synthetic Construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8354 - DNA, 2892 bp, Artificial Sequence
  Description of Artificial Sequence: Synthetic Construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagagtggtgtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 8355 - DNA, 2208 bp, Artificial Sequence
  Description of Artificial Sequence: Synthetic Construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgagtccaggagagtgcggcgcaacaagaggagcaaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8356 - DNA, 2172 bp, Artificial Sequence
  Description of Artificial Sequence: Synthetic Construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8357 - DNA, 2172 bp, Artificial Sequence
  Description of Artificial Sequence: Synthetic Construct
atggactggacatggatactcttcctggtagcagccgccacacgagtgcacagcaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8358 - DNA, 2172 bp, Artificial Sequence
  Description of Artificial Sequence: Synthetic Construct
atggactggacatggatactcttcctggtagcagccgccacacgagtgcacagcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttcaggtggcggtagtggtgggggaggatctggaggcggaggaagcgggggtggaggttcaggaggagggagcttgcaaattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgagtggtgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8359 - DNA, 2235 bp, Artificial Sequence
  Description of Artificial Sequence: Synthetic Construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatcaggttccggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8360 - DNA, 2241 bp, Artificial Sequence
  Description of Artificial Sequence: Synthetic Construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatctggttccggatcaggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8361 - DNA, 2247 bp, Artificial Sequence
  Description of Artificial Sequence: Synthetic Construct
atggactggacatggatactcttcctggtagcagccgccacacgagtgcacagcgactacaaagacgatgacgacaagaactgggtgaacgtgatctccgacctgaaaaagatcgaggatttgatccagagcatgcacattgacgccaccctgtataccgagtccgacgtgcacccgagttgcaaggtgactgccatgaagtgcttcctgctggagctgcaagtgatcagcctggagagcggcgacgccagcatccacgacaccgtggaaaaccttatcattctggccaacaatagcctgagcagcaacggcaacgtgaccgaaagcggatgtaaggaatgcgaggaactggaagagaagaatatcaaagaattcctgcaaagcttcgtgcacatcgtgcagatgttcatcaacacttcttcaggtggcggtagtggtgggggaggatctggaggcggaggaagcgggggtggaggttcaggtggaggcagcttgcaatacccatacgatgttccagattacgctattacctgcccccctccgatgagcgtggagcacgccgacatctgggtcaagagctacagcttgtatagtagggagcggtacatctgtaacagcgggttcaagaggaaggccgggaccagctcactgaccgagtgcgtgttgaacaaggccaccaacgtggcccactggaccacccctagccttaagtgcatcagggacccagcgctcgtacaccagagacccgcgcctccctctacggtaaccacggcaggcgtaaccccccagcccgagagcctgtccccgagcggcaaggagcctgcagcgagcagcccctcaagcaacaacacagccgctaccaccgcggcaatcgtgcccggcagccagctgatgccctcaaagagccccagcaccggcaccactgagataagcagccacgagagctcacacggcactccctcacagaccactgccaagaattgggagctgaccgcctctgccagccaccagcccccaggcgtgtatccccagggccacagcgacaccacggtcgccatcagcacatctacagtgcttttgtgcggccttagcgccgtgtcactgctggcatgctacttgaaaagtaggcaaactccccctcttgccagtgtggaaatggaggccatggaagccctgcccgtgacctggggcaccagttctagggacgaggaccttgagaactgctcacatcatttgggatcaggttccggaggtggatctggatccgaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8362 - DNA, 981 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8363 - DNA, 981 bp, Artificial Sequence
  Description of Artificial Sequence: Synthetic Destabilizing Domain (DD)
gaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggctaggagaatttgctgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcagtga

SEQ ID NO: 8364 - protein, 415 aa, Homo sapiens
DEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 8365 - DNA, 1251 bp, Homo sapiens
atggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataa

SEQ ID NO: 8366 - DNA, 1248 bp, Artificial Sequence
  Description of Artificial Sequence: Synthetic Construct
gacgaggccgacagaaggcttttgagaaggtgcaggctccggctggttgaggagctgcaagtcgaccaactgtgggacgccctgctgtccagggaactgtttaggccccacatgatcgaggacatccaaagagccgggtcaggatctaggagggatcaggctaggcaacttattatcgatctggaaaccagggggagccaagcccttcccctcttcatcagctgtctcgaggatacgggccaagacatgctcgccagttttctgagaacgaaccgacaggccgcaaagctgagtaaacccaccctggagaaccttacccctgtggtactcaggcccgaaatccggaagcccgaggtgctgaggccggagactccgaggcccgtggacatcggcagtggggggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcagcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagctga

SEQ ID NO: 8367 - protein, 285 aa, Homo sapiens
GVDGFGDVGALESLRGNADLAYILSMEPCGHCLIINNVNFCRESGLRTRTGSNIDCEKLRRRFSSLHFMVEVKGDLTAKKMVLALLELARQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 8368 - DNA, 855 bp, Homo sapiens
ggcgtggacgggttcggtgacgtgggagcgctggaaagcctgcgcggcaacgctgacctcgcctacatccttagcatggagccgtgcggacactgtctgatcatcaacaacgtgaacttctgcagggagagcgggctgcggaccaggaccgggagcaatatcgattgcgaaaaactgaggaggaggttcagctcactgcacttcatggtggaggtgaagggcgacctgaccgccaagaagatggttctggccttgcttgagcttgcgcggcaagatcacggtgcccttgactgttgtgtggtggtgatactgagccacggctgtcaggccagccacctgcagtttccgggtgctgtctacgggaccgacgggtgccccgtgtctgtcgaaaagatagtgaacatcttcaacggcacgtcctgcccctcactgggcggcaagcccaagctcttctttatacaggcttgcggtggagagcagaaggaccatggcttcgaggtggccagcaccagccccgaggacgagagccctggtagcaatcccgagcccgatgccaccccatttcaagaaggattgaggaccttcgatcagctcgacgcgattagctctctgcccacccccagcgacatttttgtgagctacagcacgttcccgggtttcgtcagttggagggaccctaagagcggaagctggtatgtggagacgctggacgacatattcgagcaatgggcacacagcgaggatctgcagtcactcctgttgcgcgtggccaacgccgtttccgttaagggcatctataagcagatgccaggttgtttcaatttcctccgaaaaaagttgttctttaagaccagc

SEQ ID NO: 8369 - protein, 431 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 8370 - DNA, 1296 bp, Homo sapiens
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 8371 - protein, 430 aa, Artificial Sequence
  Description of Artificial Sequence: Synthetic Payload sequence
PNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 8372 - DNA, 1293 bp, Artificial Sequence
  Description of Artificial Sequence: Synthetic Payload sequence
ccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcaactgcctaccctgccgctcgtcatggtggcccccagcggcgcaagactgggcccgttgccgcacctgcaagccttgctgcaggaccggccacatttcatgcaccagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccctga

SEQ ID NO: 8373 - protein, 396 aa, Homo sapiens
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 8374 - DNA, 1188 bp, Artificial Sequence
  Description of Artificial Sequence: Synthetic Payload sequence
atgccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccc

SEQ ID NO: 8375 - protein, 395 aa, Artificial Sequence
  Description of Artificial Sequence: Synthetic Payload sequence
PNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 8376 - DNA, 1185 bp, Artificial Sequence
  Description of Artificial Sequence: Synthetic Payload sequence
ccgaacccaaggccagggaagccctctgctcctagcctggccctcggccccagccctggcgctagcccctcttggagggcggctccgaaggcttccgacctcctgggtgctaggggccctggtggaaccttccaaggcagggatctgcgaggaggggcgcacgcctctagctcaagcctgaacccgatgcccccctcacagctgcagctcagcaccgtggacgcacatgcaaggacacccgtgctgcaagtccaccccctggagagccctgccatgatcagcctgacgccgcccaccaccgcaaccggcgtgttttcactgaaggcaagacccgggctgccaccgggcatcaacgtggccagcctggaatgggtgagcagggagccagcgctcctgtgtaccttcccaaacccatccgccccaagaaaggacagcaccctgtctgccgtgccccaatcatcttacccgctgctggcgaatggcgtatgcaagtggcccggatgtgaaaaggtgttcgaggagccggaagatttcctgaaacattgccaggccgaccacctgttggacgaaaagggaagggcccaatgcctgcttcagagggagatggtgcagagcttggagcaacaactcgtgctcgagaaggagaagctgagcgccatgcaggcacacctcgccggcaagatggccctgaccaaagccagtagcgtagccagctccgacaagggtagctgttgcatcgtggccgcaggaagtcaaggccccgttgtgcccgcctggagcggtccaagggaggcacccgactcactgttcgccgtgaggaggcatctgtggggcagccacggtaacagcacgttccccgagttcctgcataacatggactacttcaagttccacaacatgcggcctccattcacctacgccacactgataaggtgggctatcctggaggctcccgagaagcaaaggaccctgaacgagatctaccactggttcaccaggatgttcgctttctttaggaaccaccccgcgacctggaaaaacgccataaggcataacttgagccttcacaagtgcttcgtgagggtggagagtgagaaaggtgccgtgtggactgtggatgagttggagttccgcaagaagcgaagccaacgacctagcaggtgtagcaatccaacccccggaccc

SEQ ID NO: 8377 - protein, 10 aa, Artificial Sequence
  Description of Artificial Sequence: Synthetic peptide
  MOD_RES (3)..(4): Any amino acid
  MOD_RES (6)..(9): Any amino acid
HDXXHXXXXN

SEQ ID NO: 8378 - protein, 4 aa, Artificial Sequence
  Description of Artificial Sequence: Synthetic peptide
GGGG

SEQ ID NO: 8379 - protein, 5 aa, Artificial Sequence
  Description of Artificial Sequence: Synthetic peptide
GGGGG

SEQ ID NO: 8380 - protein, 8 aa, Artificial Sequence
  Description of Artificial Sequence: Synthetic peptide
GGGGGGGG

SEQ ID NO: 8381 - protein, 8 aa, Artificial Sequence
  Description of Artificial Sequence: Synthetic peptide
  MOD_RES (2)..(2): Val or Ile
  MOD_RES (4)..(4): Any amino acid
DXEXNPGP

SEQ ID NO: 8382 - protein, 7 aa, Artificial Sequence
  Description of Artificial Sequence: Synthetic peptide
SGSGSGS
